United States Patent 10,233,495 (METHODS AND COMPOSITIONS FOR SCREENING AND TREATING DEVELOPMENTAL DISORDERS) - sequence listing, part 15

SEQ ID NO: 19 - DNA, 2076960 bp, Homo sapiens (residues 1,038,481-2,076,960 of 2,076,960)
  misc_feature (94448)..(1860108): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctagagccagaaatactatttgacccagccatctcattacagggtatatacccaatagattataagtcattcttcctataaagacacatgcacgcatatgtttagtgcagcactatttacaatagcaaatacttggaaccaatccaaatgcccatcaatgatagactggataaagaaaatgtggcatgtatacaccatggaatactatgcaaccataaaaagaatgagttcacgtcttttgcagggacatggatgaagttggaagccaccattctcagcaaactaacacaggaacagaaaaccaaacactgcattttctcattcataaatgggagttgaacaatgagaacacatagacacatggaggggaagatcacacaccagggcctgttgtggggtgtggagcaagaggagggagagcattagaataaatacctaatgcatgtgcagcttaaaacctagatcataggttgataggagcagcaaaccaccacggcaaatgtgtacctacgtaacaaacctgcatgttctgtacatgttctgtcccagaacttaaagaaaaaaaaaaaacaaaagagagaaaatctcttaaaacttcatagaatctctaactttattaatatagtcagcatacaacaaggtaatcataaaggtaacatgagaaataaaatttcatgaaagcatatgtttgtagaaatagcttgtttcaggaaaaacatagtcttatttttaaaaaatggtctcataatattttatggcataaaatagcttcttttctgacagccatgtatatctttacaaaatacacatagtaatcaactaatagccaatcctcatcaggatcaatgaaaatcaattgttaaagtaatataaattaatacacatttattagggaaattccatgaattatcttttggataaaactatctagtctgtaaatggatcaggtttagtccgtttacagggtaggtactaaggccagaaacattcaagagagagattcggacttcagaaagacgaacttgagagagttcgctgcagagcataagtactaattcaggactagtggaataggatagcatacaaaagacatggggaagaagagagtatttgtttccatgcatgcatgtattgatacaagcaagcttccatcaaaaaatgactttcttctaaaggttcatatggcattaacattaacacttttcctttactgcctcacagatcagcttttcctccaaagattctctttctggaaaataaagtccagaaagagaaatatttcattgttacagtcataaaaattatacttattcactaatgctgcagccagggtagaagagagagaagttccaactttagccatactttcatcaacttttccttctacttttaaagacaagcatacagcaatgaaagtgagtgttgttattctggagaaattctcttaaatttatgaaagaacaaattgctcataattatgagattttgcaatcagtaatacatttcttattatagtttttatcagtgtacctcaacagggaaggttgagagtttctgctcaacatgataccatattacagtcatgcgccccataacaatgtttggtcaaggacagacttgtatataagatggtagacccataagactatcttattgtattttactgtaccttttctatgttgttgcttgtttagaaacacaaatatctaccattgtgttacaattgcctacagtattgagtaaagtaacatgctataaagttttgaagcctaggagcaataggctataccatattgcctagttgtgcagtagtgggctgcaatttaggttagtgtaagtacactctatgatgtttgcaggaaaatgaaattgcctaacaacgcatttttcagaaagtatctctgttattaagcgatgcatgattttattccgcctcccttcttactcacctgactcctcattttttcattttccttgcttaactcatcatttgtcaattcttgccagttcttactcctctgcagtgtatttaacattcatcctttcactatcatttccattgtcatgtctcatatttctattctctgtcatctggaaaattgcaaagtttccatgatatggcacattgtggcctgagaatatttatatgtacattttccacttctattgcactctttcatgaaattcaatgaccacagtagttccttgttcaaaagccaccaatagctttaaagcacttatctaaaagtgttcaagtagcctggtcaaatatcaacatagcttacagtgatttcactcttattctgcaaaaaggttatgatttaatctggacgtatcttgttctttcctgattcttatcagaccatttcttctgtcctctagaatatagatttcatgtggccagaaaatttttctgttttgttccctgttatacttatggtccctaatgatgtgtaggcatttaacaaatattaatagtgaaaattttttaatgaatcagttcataagtacatgaatatttcaaatagttttgtccacattttttaacctctggaaattccccactttttattttttaatgccgttgaccacagtgagtggtttggtctcatcataaaggaagatggattagaatgagtaagaattctttgatgagttttaggaaattggaaagatgtcctgttattgtttattcaacaagtgcttactgattaactcctgtgttcaaggacctgattccgttgtttctatctttaaaggcctcaaaatctagaacttgaaatagaaagaaaacctacttaggacatattgcttatttcaatattttgatatttaatcataaaataaaatgaaaaaacatagaagtcagttattttatttacttgaatacattggagaatctctgaaaaggtcactcagaagccagatttgaagaacgagttgaaatttactggagacataaatagaggaagggaacagttagaagatagcccatgagtggatttaagaattttcagatcagttgtggtggctcatgcctataatttcagtactttgggaggctaaggtgggaagatcacttgaggccaggaggtcaagaccagcctggttaacagagtgagaccccatctctacaaaaatgaaaagcaaaaaattagctgggtgtggctgtacacccttttagtccaagctgttctagaggctgaggtgggaggattgtttgaatccaggagttcaaggctgtagggaaccatgattacaccactgtactcccccaggctaggtgatagaacacaaccctgtctcttaaaaaaaaatatgactttgaaacattatgataaagtcctgaaagtgctcttagttgcccatccatttgcacaatggaatagcatgtgctgtgataacagaagtgtagggtgccatgagagccaattggaagatcatcatacctggattataggaagaaataagggaaagcaacaaggaagatcagggaaagtagaagctgacacattgcaggtgactcaaacgtaagtgggtgaagaaagaataggtaaaggtctacttaaaaaaaagaaaataaacagcatcaaatttaagaagttatacaaatttattttaaaaagcaagatatatgagggtaacaataacaataaaatcataaatcataaaaaatataattgcaaaatcctgactggattgtttaaaaaagaaacaataagaaaatagatgtttcaataaaatttaatcaagataaagtacacatttaaaaattagaaataaagcatatgacaacagacgtgaagatatttaaagttgatactatgatatattaatattttaagtcttaataaagtagataatttaactttaataggtgaacatagcaataacaaagtagtatatactaaaaaagagtaacttttctccaaaaaaacttttgcaagcaatggacttacagatttccttcaataatcaagaaatgtgaaacgtcaacaaaatgttcaatgacatacaaaaatggggggatccaaatttttaacaaaacttttgtaaatcggatatataatctgataatggcaacagtgaagaaaattacagaacttctttcagataaacatggaaaatcttagaaaaacttaccaatatgttaataggaagtaatatgaaaatcagaataaatatcataaaattattgaacaaaactcaagattgatttctgattaaaaagaaaaatacagttataaggaaaagtagaattactaacatctaactaatatattaaggatgtcaatctaaaatttgctaatagcatcatatttacaaaataataactattaacatgagaaggaatgtaagatttaataattagcattatattacaattctgggaattctgatcaatgcaataaaatatcaagcagaaataattaatttgaaagaggtgataacatattatttacaaatattacaagtaaaaggaaccttaaaatgatcattttctataatttattatagtaaattgttaaagtctaccttaggaaaataacactaagagaaaatgttaacaaaaatatctttggagttatttatgttaacaaaatttggaaaagcctaaatatttagctagaaggaaacggtacattgatatagactggcattaaacttagtttcttgatttgattaaacttagtttctatgagacatttgtatcattcaaagttgtatgtatagacactgactgaaacacaaagtgggttataatattgaatatgtgatataatggcaaccatgaagaaaatatcagagaatcaaatggaaggaaaagagcagaacctgaataatgattacctttggacagtgggatcttagttccttttactcttcctactaatttaaaatttgcaaatttattaccttgagaatatgagaatacattgtatttataatcagaaaacataaaatgagtgctaaacaaacaaatataccaaattctgtttagaattcacttccccaagaaactttccttgattaatcccactggcattgatcattattttatatggcacccccatacttatgtattcagtttctaccatattaatttgcatgttttaaaaagtcaatttataagcataattatggcatttctacatttatatagtgtagtctccaaactgaattataagcttgaggatatgaggaaccacagtgtatttccaactatatttatacaataaatcatgtggtacttttcacagagtgaatgttgttaacttactgaacacctgatgaaacatgggaaagatggcaatgtctcacaagaggaacagacgtgaaataaaatccaacattctgtataattcttagtgtctcttaaccctacttgttgaattacaaaaactacatatacaaaaatttgagcattgtactctttagctgtacattatcatttcaaaacaaacttatacatggctctcactattacaataatcttcccactgtaaaaacttttaagctgtaaatttctgccattactacattaccttcatattaatttatgccatacttctttctgagtttctgtcaatattcatctcaagtatttttgtgtaaaaattagatagtaacaggaaaatagataactgcttctagtaggtagaagtcattactacagctttgcctattaacacatacacactatttcttcatgtcccagatgttcaggtatatgggaatgaaacaaattaatgagttggaacctcttgattcagttattctggtgacaaaatctgtatagctcatggacgattgttttacccttgacaaagtggctgcaattgttacttacagatgtagccacatttaatttcttttctccactccccactgcattgtatttgttattcttgatatgagaaatgtgttaagaaacatgctactaactgcatgtgctccccatacaattagctacagaaagaggtgataactcatattatttacaaatattacaagtataaagaaccttaaaataatcattttctataatttgttatcaattgttaagtttattttaacaattatcaattagctacagaacacgagtagtgtttcttactttagccagatgtaaacatgtgatgcggtaatatagtgaagaatattactcacttcaggggatagggctttagtcaagaattttgagaaactcttgaaaaaggaaaagaaaactctccatgatagtaatacaattctaaaagcaaaaggagaaaaaatgtaaatgtattaaatcgaaaaatattttacggtaaggcaaaagtgggtatagaatggtgagtcacacacaaattgtgaaagtgagtaatgacccagaaatcaaaggagagggaaaaatatggtaggtgaatatggttgcaatgctaattaaaaaatgttattagcgactagctcaattcaagttttgaataaatagaaatagagtgtttataatggtatgcttaatatactggtgacattattaagataattgttgaaatatacttaaaagaagttagtgaaagcagagaatgaaagactattgaacttttctggtttgttgtgtaaaaatttgcctatatccaacatacaggcaaaaaaataaaatactggaaatagagagcaaatcttggccattcaaatgagagtcagctattaattctttggtcataggctgtattcctacaagcaaactttggctaaaatatgcgattcaatacagatactcatttttcaactgtttacaacctgtttgagtccatttggactgctgtaataaattaccttagactgggtaacttataaaccaaatttattattctcagttctgggcgttgggaagtccaagatctaggtgcctgcagagttgttacctggtgaggtttgtttctcaaacttactgctacatcttcacatggcataagggcaaaaggggcaaagtagctccctatgggttcttttataaggggactaagccattcatgatggctccccaacccccttaacctactcacatcccaaagacctcccctctttatttatttatttatttatttatttatttatttatttatttattttttgagatggagtcttgctgtgttgcccaggctggagtgcagtggcacaatctcagctcactgcaacttctgcttcccagcttcaagcaattctcctgcctcagcctcctgagtagctgggattacagtcatgtgccaccacacctggttaatttttgtatttttagtagagatggtgttttaccatgttggccaggctggtcttgaactcctgacctcatgatctgtccactttggcctcctaaagtgctgggattacaggtgtgagccactgtgtccagcctggcctcacatcttaacaccaacatattgggaattagatttcaatacatgaaatttggagagatttaaactttcagcccacagcacaaacaaaggatgaatgtttgaggcacctgtcaaaatacacatttgaaaagatcagaatgtctgcaacgtcaaatgaattacattagtagaggcaaattctaacaatgaaatgagaagaactgcaaacagaaagaatcacagagagaaccatctaattttaacattgaggaaaaactttgaatgtgggttccattcaattgtacaacaactcaatgtatacagcgtcaacacttttgaaacattgagataaaatatttttggattttatcaaatttgatgtaatgctagaagaagaattcatactttgaagggactgtgataaatttaaggatatatttacttctgtttgcacttgctacatgctgtttccaatatgaatattttcacaagatttacatgtctaatacatgagttggctcctgaccttgaagcaattgttagcaatagatacacttgtaaaaaaaaataggacttctgctgtcctgcatgaccatggacatgtacatcttagtatttatgcataataaaaactttcagttcagcttagtaaatatttattgacaatgtgctaatcatgaggaggactgtggataaaggtggatgataaagataaatttaagttgggaaaactaccaccactacatctacaagggctgaaagtatatacaagtcagaagcacacagaaatcactgaaccacaaagtaaatggccgtaagtgctgttatatacccaaaccatgtcctacttatatagtcctttaaatggataaataatacattaaatctgactgggaaggaagaaagtttctaggaatagttctttaaaaagttgcatcagttttgattaatacatagaaagagactgttacagaagaagagctagctaacggaagacctagcataattttattcttgcacaatatcagagaacccaacagttttgtcagcagtagctacttttaatttatttggatacctgagatcatctgggaagactgtggtaagtaaggctgctgatgaagactttgattaagaaaggatttatcaggagctgggcacagtcgctcatgcctgtaatcccagccatgtaggaggatgaggcaggaagactgcttaagtccaggaattagagattaacctgggcaatatagccagaccaccttctctacaaaaaataaaaaacaattagatgggcattgtggcacatgcctgtggccccagctattggggagactgtggtaaaaagatcacttgggaccaggagtttgaggctacagtaagctatgattgtgatggcagcggctgctgccaacacgccagctgcaggggagaggtgtggccggggttgtatgctccctggagttggcaggatggggacaagtgggagccctgccctttctgagttggaatgggagctccctgggtgctgctgcagctgcccaaactgcagctgtagctgtagagctggacctcccactccatggagcagacaggagtttatccaactcccctactctgtccccaccccagcccaccacccagccaaccaaaccaatgctgcagactcaggcaaccctgcactcttggggaggctgggaatgacccccttgccccttgcaggcttggaggctcctcctcctgctgcctggtctctcccacctcctggctctgtgctctgatctcagagtgggtttgggacccagcagggtgctgtcacagcccagccaggtgtgcacacattggaagcagtgctgacatgccagtcccctgccacctcagccccctctggactttggacaccgaggagcaggaacatgggaggggaagctgagggggtccgagggtggctgggcactggcctgcaagtgccctttgatgccagaagcctgggtgccatggatggctgtgggaggcagacaggctcctgggtggaagggaatgggtccccagtgaagccccacctgcaggctaggctgccagtcctgcagattggaggcaaaactcatggtgctttttcctgggcccgcccatggctgcccatggaccaatgggcatacacttcctcccctctgacatccataaaagcccaggactgagccagaacagggcagaagacagaggagggaagactagaggcaggaaggagttatcctttctgctgatagctggagacaatgggagggccagctactttctctgcggaatgcttcagagacctacagagatgtctgggaactaacagctgcagatggaagcaaccctctccagggcttccctttctgctgagagctgaacacttgacagaacaacctagagaggagctacccactatgggtctcctctgagctgttctggcacttaataaatctcctctcctttaacccttcacttgtctacctacaccattcttcctggatgcaggacaagaactcgggcaaagatgccaccaaccacagttttccaacaagaaaatcgacaccccaaagattccataacaattgcaccactgcactccagcctaggtgacagagtgagaccctgactcttaaaaaaagaaaaaaaaaaagaattatccacaagttattagataagactgctaatagtttctaattgcgataccttcccgtttgaaatggaagggatggaagttaacaccaggtcagttttctgaaagttataaccctgcttttggcctctttcagctccagtcagacattagcaattctcagttaccttcaatattaagccggtcctgacatgaaactggcagcatttgagaacactgacccagacttgaaggtagatctggaattaggattgctgctttaagcccagtatcaaggtatacaatgaatcatgaatttctcataaacgaaatttagtggatttttttcctatatttctgctgataactttgcctggattatatatttaaacaattcatttgctgtaacttcattactgtcccaaatgttttgggttgacatactgatgttagctagtggttttggtcttaagtttcagtagctgctccaatgtaaaatgatcacacataaatcttaggtttttactcatatgataccttgtctgatactatcttcatctatcaaataaaggttttagtattttcttagtcaatgtgggctgctataacagaaaacacagattgagtggctaaaacaacaaacatttgtttttcacagatctgtaggctgtaaatctgaaatcagggagtcagcatggttgggttcttggtgaaggctgtcttcctgacttacagatggctctcttattttatcctcacatggaggagagaaaaatctctctcgtatatcttcttagaagggcactactttcctttgatgagggtttcctcttcatgacctaattacctcccaaaggtttacctcctaatgccaatacattgagagttaggatttcaacgtatgaatttgagggatttgcagttcataataactatcaatgtcaactcagttcaagtttgaatttgttttgctttgggtgacaaatctctaactaatttgaattcatctttccccagtctggttcaatgttgtcttctttctccttcaccaccaacagttagcaagatgtcaattttacttgaggctaagtctgttttagttatcacaatagagaaccctgtaagctatatgttagttgcccctttcataatatttttcattacggaaaaaatacattctaaacattgttcctattctaagaaacttggctgcatctttgcaacaaaaataatgtggacctttgccaaatacagctgtagagaaaggtaaaatcattgctctgaattattcataaaatcacagaaattagggacaaacactaaataaggatgaattattcagtgacttgaaacagatattttctttattttctcatgtaatttgaaatgtactgcaatttacatcctcagtgttataaacatgtgatgtttcacttttagttaaaagcacccaacagaacttgttaaataaatgagttttttctcttcccatctctaaaagcatttttatacctactcatctacaaatatgttttaatagacctaacctctctatgatgtcattttccccttgggtaccagaatatatatttagtcctatagaatgatttagctctcaggttctgagttactatttcccaggagttgcattgcccaaagtaatgtggacatttttctcattttaaatttcaactcacatggtcctttggttttgttacattttgtacctgttttgattgtttttttcctctctatggaaattatttgccaaataaggagaaaaagtgttgatgtttttccttattcaaaaattatggtagataaaaaatctgattaaataactctattacagtctttctcaaatttttactaagataaacatgaaggtactgaaaaggtgaaattctcagctattgaaaatttggaatgtaggacatcatgccgagatttgaggaaaagtatcaataatttagcaagggatggtagtagatatacaaaaagcaattagaagcaataaggccttggattcttttcatgttaaagaaaatacattctgaaagtaagtacaaagaccctttgtatttcctttataacctgttccctaacagaataccagggcctatgccaagggaaaaactgtgtagatgtgtttttctcttctggtgctgatatggtcataggatggggacgctcgctctttgctatttctctaaccaatcgtattactacatcaattaatatcaaaacatttcaagtctagttactgacaacagagtaaactagagtggactcctgactcataacaaggattcagatctagagttctcatagagtgaagaaattatgtttgcaactgagaaacgaatgtaaaaaccgtcaggaatccctggagagtctgaaagtccctgagccctgatacagagagcaaatggcagtttaaggctgaccacctctcattccctccactatttctcacataagaatatacagtacactcttcactgctctctctgcttcaagctttgcccttccacctctctatcccacagagaaagtagaatgctcctcttaaaatacaaggtagattattttacttatctgcttaaaaacttttcaatggcttctcatctcattctgaataaaattcaaagtgctttccaggtttacaagtccctgtatgatcctgagccttgacaatatctctgacaaaatctgcaacctcccattgatcactccttctctgtcacaccagtgtccttgctgctgttttgaaatatagaaagcatgattttacttcagtgtctttatccttgttattttctctgcctgccttcttctatgtattgggcattccatatgactcatctcctcattccccttagtcctttttccatgtggcatttgaatacagaaatcttcactatctaaaattatactcccatatccataacttcttttattgctctagatatccttacagcatttatcattaccacttattagcttatttgtctttccttactaaaatgtaaactaaatacagacagaaatttttgtaattaaagaacacataacaaaaaaatctaccatcttaacaaaattttaagtttgcagaacattttgttaatgatatacacgttgttgtacagcagaaatctagaatgtttttatcttgcttgactgaaactccacacctggtgaacagcaactccagatttcctgtttcctccaggccctgacaactaccattttatcttctgtttccatgtgtttggctactttcaatacctcgtataaatggaatcacgatatatgtgtctttgtgtctggcttatttcacttagcacaatatccttaagattgacacatgttgaaatatgacagaatttcccttttcaaggctgaataatattccattgtgtgtgtgtgtgtatatatatatatatatatatacacacacatatatatatataccatacatatatatataccatactatatatatcatacatgtatatatatcatacgtatacatatatatatatatatatatatatatatatatatatatatatataccatattttcttcatctgttcatttgatgatggacttttagattgtttctactttttggctgttgtgagtaattctataatgaatatgggaatgcaaatatcacttcaagatcttgttttcaattattttggaattattcaattattttggaaaaatgcccacaagtgggattgctgtatcatatggtaggtctatttttttaatgttttgagggccctccatactgttttccatagtggctctaccattttacattcctactgacagtacatagggttctaattcaatttctccacatcttcatcaacacttgctattttccttttttaaaaaatggtcatacagttatgaggtgataaatccttttgtgattttaattagcatttccctgatgattaatgatgttgagtatctttttatatccctgttggtcatttgcatgtcttcctgaaaaatatctatttaagaatttagccatttttaaattgggttatgtgtttatttgcttttgagttataggtgtttcttatatattttggatattaagcccttagcacatatacagttttcaaatattttctccaattctgtaggctgcctgttcactccattgtttccttttttgcacagaagcattttatcttgatgtaatcaccctaacctatttttgctttggttgcctgtgcttttggtgtcaaatccaaggaattattgccacgaccaaagtgataaagcctttctttatgttttcttgtaggagctttacagctttagttcttacatttaagtgttcaatccatttggagttaacatttgtgaacagtgtaagataagggttcactttcattcttttgcatatggatatccagttttcccaacaatatttgttgaagaaattatcctttctgcattgtaaagttttggcaccctcgtcaaagatcatttgactatatgcaagtgggtttatttctgggctttctttctttctttcttttttgagatggagtcttgctctgtaacccaggtgggagtgcagtgttgtgatcttggctcactgcaacctcttcctcctgggttcaagtgattctcctacctcagcctcccgagtagctggaattacaggtgcccataaccatgcccagctaatttttgtatttttccatagagacggggtttcaccatgttagccaggctggtcttgaactcctgatcttaaatcatccccccgccttggccttccaatgggctttctattctgttccactaatccattatcttccattcatctatatgattagttttacattaatatcacactattgggattgctgtagctttgtagtatatttcaaagtcagaaaatgtgaggcctctaactttgtttttctttcttatgattgttttggatattcagggtccgttgtggttccatatggattttaaaattgtcctttctatttctctaaaattagcattggaatttttatagggattacatcaaatctgtaaattgctttggctagtattagaatttgtaaatattctttcaattcatgaaaattagatggctttccatttacttgtgtcttccttaatttctttcagcaatattttgcagtattcagtgtacaagtctttcccccaccagctaagtttattcctaagtattttattcattttgatgccatggcaaatggattgttttcttaatttccttttcagaatgtttgctctttgtgtttttttgaatctttactttgaatcctgcaactttgttgaattcattttattagttctaagagctttttgttgaatctttaggggtttttttatatataagatgatgttttctgtgaatagagaaaattttacttcttcctttccaatttggatgccttttatatctttttcttgcttaattattttagctaggactttatgtacttcataaagtcatccttgccttgttcctgatcctgatcttagaagaagagatttcagtttttcttcattaatatgatgtgagctgtgggtttttacatatggcctttattctgttggaataatttccttctattcctattttttcaagtgtttttctaacgacagaatgttgaattttgtcaaatgctctttctccatctacagagatgaacatgttattttaattgttttgttaatgtggcatattatattgatttgcacatgttgaacccttcttgcattccaggaataaatccatcataattatggtggatgatactttatagtgctgttgaattcaatttgctggtatttgttgaggattttgcatctacattcattaggaatatttaacttttttttcttgtagcgccattgtctggctttgatattagggttgtgctagcttcacagcaggagtttagaattgttctttcttctttaattttttaggaatgtttgagaaatattggcattaattcttccttaaatgttgacagaattctctagtaaagtcacctgtgcctgagattttctttgctggaagatttttgattactaatttaaacaccttactagctacagatttgttcatatttttatttcttcttgattcagtgttgtgggttgtatatttccagtaatttgatttttttctaggttatccagttactaccataatcattcacagcagtctcttataatcttttcttatttctgtggtatcaattgcaatgtctactttttcattttttattttatttggttgagtcttttttctttttaattgccatattccattgtatagtaataccacagttttttaaaatctattcacttgcattggttctactttctggttataatgaaaatatgtgtgtgaaaatatcctttatttgcattaatctttattatttccttccttttgctgggtttgggcttagttctccttttttagttccttgagttgtaaagttaggttgtttatttgagatccttcttctttcttaaggtaggcatttattgctataaatttccctctttagtcctgcctttgctgcatttctaagttttgttatgttgtgttttttattttttttttgtcagcttgttttctaatattctttttgatttcttctttgactcattggttgttcaattgtatgttgtttaatttccatatatttgtaaatgtttcagttttccttctactattgaatttttgcttcatcctacttttggtcaaaacaggttcttgatttcctttgtcttaaatttgttaaaatttgttttgtgacctaacatgtgatctatcctggagaatatgtcaggatatgtcactttgccagataatttatatacctccatttttgaagggttgatatttgaaacttattttgttccttttattgggccattttcccctgtttccttttgtaccttttaattttgtgctgcgattctaggatttgaaaaaaataaccacttctctctgtctttacagactggttttgcactgggaaatcctttcaccagtcagcccagctagagattctgaagtgtgtcaaatctttccgtgaatgtattgtctctggaattgtgtgtaaattcttagaaaaatttgcaggtctttcttcaggagcgtgtaatctcttgctctctttgttatctatctgtagtactgtagattatctggagttgctataaccccctagctctcttttgttctcagcagtcctcagacatcaagagtattcggtcagacagaaaacagtccatcaggctgactgggaaaagttggaattctggatgcacactccagctttttccttctccaaggggaagccaggagttgagggttttctcccactcattgcatattgatccagggaaggatagtatgataagtgaatgtatgctaacccaaactgcctcaactcatttgttcttaatatccacaacctggaaagctttcctgttagcacttaaattcaggcaagacagaaaacaatcacttggcaactcccctgaagtctgaacactgaatgtgtgcctctgtattctctttcacttctgtgggggaatcaggaactgtagagtattctcccaatcttgttatactgagtcacaggaggaatgatggtgattgagtgacagtccaaactgtggctttatcagcaggcatgcaatctggcatcctttcctgttagcacttagattcagggtagataggttctagtgccttcccaaaaagtcaaaatgttggacatatggtctagaattttctttctctccctagagatgagctgggagtttggagctttctctccattgcgttgtactcctgagggaggatgagtgagtgcaacaaatttacctgctggtttagatgtgcctggcttgaagcctaccagggaatccagagtctttaaattcgcctctgtacttttcacaaacgggatttatctgtgtattattatcgagctggtgtctccttggagaggagtgtggaggggctttgaggctttctatttcatcatcttgctggtgtcctgacaggaattttaaactgggctcctttccccgcagtgtgggagaatggatcctggctgattataagtactcatgaaatactggataaattattatttatcatttacttacaaatatttaaaatttttattatgggaaataagttttcaatcactactaaagtttgttgaagcactacttcattactgtgaaaaatggggaggggaataaaaatcaagcatttgtctacttatcttgttttcctgtccaaactgtgttttggtgtaatcaatacacatttgggaggaaatgttctcttagaaattattctagctaataaatgaagaaaaaaatgaaagaatgtagtaccctcttataacacctagtaaaataatggttgaaacaagtttcctaatgaatgctaaaaatattaggtgaaaagttgatgcaaacctttactgtggtggaatgtggctgacattaatttcttatctgaattacatttttgaaactttatgactgaatttaaaagggattttggtgtcattattttttcttttacactctcctttttcacataaaaatcaactattaactgattggttttatggtcttttggaaagagactatataaattctgctttttgtatgaagatctcttttacactgtcagaagaaattttacctctggtaagctctgatttcatccttcaattttattttgaatttctttctttgtcttttgttttatcagcaccttgtttaatttaaaatagattcaatgtcaacagtcaaggagttaactcaggaaactaatttatccagacatacaaatatttttgcatatattttatcctttgtttcagatctttaatatgtaatttctaaaaatgaaatatggacagtttgcttgatttctgagcatagtcaatgaataattttaccaaaataagcaaacatttttcgagcttttttttttccttgagactgagtcttgctctatcacccaggctgaagtggggtggtgtgatcttggcacactgcaacctcttccttccaagttcaagcaattctcctgtctcagcctcctgattagctgagattacagttgcccaccaccacacccagctaattttttgttttattttattagagatgggatttcaccatgttggtcaggctggtctccaactccccacctcaagggatccgcccacctcgaactcccaaagtgctgggattatggtgtaagccacaacacccggccaagagcatttggatataatgagttactggggaaaccttttaatataatgttagacagcccatttaaaaagaatccagtataattattatattctttatatgactacatttcacagtgaagtaacttagcactctgtatttataatgctttgaaaatacatattagttgctgattttatattccaaacagaaattataggacatcatattatataaacacaagaattcaatattaatttttacactttaaaacaataatcttggccctgcacggtggcttgtacctgtattcccagcactttgggaggtcgaggcaggcggatcacgaggtcagaagattgagatcatcctggctaacacggtgaaaccccgtctctactaaaaatacaaaaaaaaaattagccgggcgtggtggcgggcacctgtagtcccgccactcaagaggctgaggcaggagaatggcatgatcccgggaggctgagctcgcagtgagacgaggtgacgccactgcactccagcctggatgacacagcgagactccgtctcaaaaaaaaaaaacttttcaatttttaaaatttttctcaaactacccatcagagaagtttaacatctccatttacagttctatgatgttatacagaaatattttattttttccccagaataatataggcaaattctctccctctgactatacacacctggtaatgttattttaattgtttaagggtttctatctcttcctattctgaatgattattctccttttgagctttcttacagtaaccattttaaatagtctgtagacaactttctagattccaggatccacattaatcttcctgccgttgcagtttctgtcttctgcaagagtctagcttttatgagaacaaaatagtcatatcttctttaaagaagagtttccagtgtaaagattaaaagtttaagttaattgtaaatgaaagactccagttagaggagaaaatatttcattttaagatgaatgtttcagaatacaattactatattgaagatgaatctcactatagccacattaattatgtctgtttcaatttaaggggacacagtaacaaatcttagctcactgaaaagaaatcaaatctgaaacatggtggagaagtatgagccctgaccaagagattttcttggaagacatagattgacttatagcaaaagatatctgaagtagtaaaatcttacactttatttttatagaaaacagacaataaaaatatttctaaattaattttgtaaaattaattttgtaaattatttttgtaaaaataacataaaaatatctgattaacttagatacataagttctttaagttccaaaataaagaatgagagaagtttatagtttgtctgacttttattcttttaatccataattaattccatagatagaataatttataatgtaactttaatcattacatcctttgatcaaaaatatacagatattcttaatttttcttctcatatttacttaaattattttccattgctttaatatttctttattcactggtcccacaatagttcactaagtttggtatttcttggttttgtaaaaaatttcccaattcaactccatagcacaatgagtactcttctctcctcttcctttgtattctttttaggtccaaccccatggctttccttttgtactctctaggccaagaatgttctttcttattcctaccatttaaccaatattcatttttcatggctgtattagtccgttttcacactgtcataaaagactttcctgagactgagtaatttataaaggaaaaaaggtttaattgactcacagttctgcatgctggagaggcttcaggaaacttaccatgatggtgggaggaaagcagacatgtcttctatggtggcaggcaaggaagaaagtaagcatgtgaaggaggaactgtcaaacacttataaacccatcagatctcttgagaacttaactcattatcatgagaacagcatgggggaagctgctgccatgatccaatcacctcccaccaggttccttcctttacatgtggggattacaattcgagatgagattcaggtggggacacagagcaaaaccatatcaatggccagtatatatttttcttttcttatctattcccgactatgtcctttctgaatttcttccatactttcaacctgccccacaaaaggcagagcttacttatatttcttatcctgttatttaaaaattaattttgcttgagtttgagaataatagtcaataggcaggggacaagcaggccatcaacagcatcctttattttggcagaaattattctgaatcaaacttaccttgtcatgggtataataacatgatctcaaaaagaattaaaaatctctatcacttgaaccacagtttcccttagcatatttaatatacttcatttttctcagctaacaaatgttagctaatatttttaccatcaagaagaatatcctttggcaaaagaatctctgtttcattagtacatattgagagagttggaccctatggcttcccaacttgatcaggaatggggaagctgggtacccagataggtaatcttctgttttgatacttatagcctgactgcacacagtgtcaaatctgggtcttgacctagcaggcacacattaacacaacatgaaggaaggaaaaagtcatttacgaaactacaatggctgcagtagttatttggtagtcctctttttaaaaatttccttttaattgaaatgaaagtttataagtgattgtagtgtaaatgatataacgttttacaatgttttattacaaaaactcaaacactccaggagtgaattaaatgtaaattgaaatctccctctctctacaatcccacatgcctcatcatttcctctattccttagaaatccaccgacaacaatttaattagaactcaaatactttcactcaaaaaaggcatatgtgtactatttaaaaaatgggattatgctaattatgatttgtagtgacctcatatttcattcaaaaatacattggatatcttgccatcatttaaaatgactgtaaattgttaatttttaccaatatttttataaaacatgtctattgaaaatttgtcattaccatctttgcattttttatacacttgtataatgaacagctttgcaaatattagttagcacacttgttcaattatttaatagagatctaatctgaggagttgagaattttcaactctttctcaggaccattcctttggagtgattttggaaatgtaggttatttttggttgtatcagtgacggagacatgaagagcacttacaagtaaagggtagagatcacatgcagcatgcactgggccaaacagtgcattgagacaaacagtcctgtagtacctcttggagaaacatggcaacatgaagtatttcactgtctactttaagaaatgttgcactatttgtgcattttacaataaatatctattcatcttataatctgcaaaacaatatactattatttaaagttcttttttgttttgttttgtttttgtttgtttgtttattgttttgagacagagtcttgctctgtcacccaggctggagttcagtggcacaatcttggctcaatacaacctccacctcccgggtttgagtgatttcttgtgcctcagtttcacaagtagctgagactacaggcatgtgtcaccatgcccagctaatttttgtatttttgtgtttttagtagagaaggggtttcactatatcggccaggctggccttgaacccctgtcctcaagtgatccttccacctcggcctcccaaagtgctgggattacaggtgtgagccaccatgcctggcctattatttgaaggatttaatcttctcccatcccaacaacaatggaatttttcaataaatccaaaaaaatatttctttgaaaagacaaataaattagatgacaaaaaagagagagcctattaaaatataacaagaaaaatggaaaactggataactgaaaatttcaaaagaatctaatatgtaccttttggtcattatatttgaaaatatatataaagaggttaattttttagggagaatttaactataaaaataaatctagaaaaataagaacatttgaagataccaacaatagaaaaaaatgaaactggtataaagttatagcacctttaaaagctcaaggcccagctgtgtctcaagcaggtcctcttaaacttaatggaaaagttaattcctgtgttgttcaaactattcttttggttaatgggagcaaaggaagcatatctctccctccatttatttcttaaaacaactgaaaaccaaaagaaaatcaacgtacaaagaaaaaaactccaccaattttgttaaaaataaacaccattaaaaattataaaccaaactatgaagactagttgtcagtgccataacaatttagcctttcttcaaaaaatggtgagagtagatgcagacacctgagcaaatatggcatgttaaacacatagagagacttattttcccacctgaagctataacatgatggcaaatggctcattcaagtgatataaaaagaaaacagcaacatttttgaaaataggatgtccataaatggctggtaactgacttagcttaccaaaaagtgcaaaattgtaagtagcggggaaatctgattctacaaaatgttcataaattggttgcacaggacacctctgaaagtagaagtaaaggtagggctaaaacccaggaagattggttgaaagactgtttccaatgcccactccatcaagcctcttaaatgcctctaggttctgctggtggaaaagtagacatttgctgtctagagaggtaacagggaatcttagtactggcaatataatcttcattggtcatacataaattaggggggcaaaatgaacagaaactactgaaagctagatctccccaattttcacctctatctagattcaaacataacagtctattagtcttataccctcagagaagactggaagactctagttggaagatcatgatcagcccaaagtaatagtccagtggatatgtcatgaggggcttttctgggaaaacttctcgacctgattgccctggctggaagccacagttgacaattattacctaagaacctggagcttaccgtaaacgtttattgtattgctcttgaacacaaacagataaccaacaatcaagagattctaggtacagccaataacaaacacggaatcaaaaaataaacaaaacaactgaaagtaaacagaatctatacagtgtgggaaaaaagtaattattaatttcctcagagagggaagatgataagatgatacaacaagaacaagatgtgatataaaatggatattcaaaaaaatagaattcttaaaaattaagaaatttattgcagaaatatataacttaatggaagatttggaaggtaaagctaactgcatctccagaaaagttagtgtaaacagagttgggaataagaaatggaaagtttaatgaattaaataattggtcctacagggccagcaacaaaatacaggcatttgggaaaagaaaaaaatacaatgaagtatgatatatataaattattttttgaaatgggtaagagttaaagtgtatgaatttcagattgaatgtgtccaccagaattcaaatcagtggtgaaaatagacctagaccaacacacacacacagacacacacacacaaatcagcacactccaggaaaaaaaaaagaagacacttcaaatttccagagaagagaaataaaagtggtcactagaagacaagcaaagccttataaattgaaaaacaaattatttctaatgcagaatagtatctccaaccaaactgtaaatcagataggaggaaaacaataataagcatttacagcacggcaagattctaaaactctacatccaatacatcctatctcaggaatttactggagaagagtttcactaaaatgaggaagtaaatgaagacagggtagggtataaagtacagggaatctcctggttgttagatgtgtggtatatgtacacagcaacctgtgtaaattagagctatctagaaaaaaaattcaaaaagataaatctgataaaatgtctaatgcttctgaatgtattatgagactcattagaaaactggggtagggtttggagttggtactttgatacatacatagaaaaacgaaaaaaacaaaaattttaaaaaattgtcagtttaagggaaaaaaaatatcgtgtagaaatgaaattcaatcatttatgctccatgtttcaggtgtgagtaacatttacctaattataacagtactagtgttactgcaaaaaggggtcctgatccacacttcaagagagggttcttgggcctcacacaggaaagaattcaaggtgagtcacagagtacagtgagaagaagacatagtttattgaaagctactgccttttagagtagggcatcctcagaaagcaagcgaaggaatgcactctctttgttttcagtttttctgttataggagttttgtctatgtaaagactaaattggaaacaaaataacaagaagaaggaatttatgcataatcttcaaatcatgaggagtaaaattcatacaggacctgtcgtttaaagagtttcatagtggttgccagtgggcattttgtgatgtttatcaatgtgattcttgaatgtaaaaaggactgcttataagatttcatattctgaattaatgtgcagcatattatattaaattgttaacgaatttaaaaaatttttgagtttaaattagaaattttattgttctatttataaaaccagtacattaaaaattatttttaaggggaactttgattaatgtttggtccatttacaacttagttaattaaactcccttaaagattttaaactacatttatacatttaatatgttcaattatctttgtgaacattttaattatcggactaacaaataaagccttcagagtacttaaacaacccttacagagctaataaattaaacccacaaaatcatgaatcttaaattatcttcaatgttaaaccattactggcaactcggtaaagccgcttataatttaaactaaaaaaaaaaacccaatatctaaaatacactgttacacatttaaaattggaatgtaaaatgctaatctatatttaaatactaatacaattataaataaatatcacatctctaaagtataaatattatagttttcatatacttcatcatctctaaactttttttcaatgttttcctgggataaaaaatttcataaaaacaattatattatcttaagcaaatggggttatcacctcagtgagttgtggctattttttcaggttgtttacctatcagagattttgactggaaaatgagatctggagcttcagatactcagggtaattgtttgtttttccctcattaatatgggaaaaaattctaacgttgtaaaagttatgttaatagagattccaagcccatgaactctaagtgaaatggccatgcaatccatgttttctagatccatgttgcctatatctttagcctgattttaatatctaacctccctactctgattgtttaggtactagattaaattcaaaaatctatttactgtatgattcttgacagagttctttttatattcttcatacctggtgaagtcataacttttctggatatttaaatgacatacacgtgtattatttaatctcgtgtatatctgattctgtggtcacatttcccaaggccagataaatgactgtagccagacagatgtagggctaggtgtaaaaggagatattcccacagattatatagttgctgtgtagagaaaacactctatgtttttcctctactctcacaccacaaagatcaatcagcaacacagaagacttctgtgaccaaatgtgtgcgttttttcctccatacatataccaaggagcagacaccagctgagtgtcctctaattcagttctgacactacactgtctacctggagatagtgtcaggtctcacaggtcagtccccaagactgcccaccctcaacctaccagccacaagcccaggcctctgaacttctgacctactggcttcaagttgggttctcatgaccccctctttgggtttgattaatttgttggagtggctcacggaactcagggaaacacttacatttcctggtgtattataaaggatattgcaaaggacatagatgaagagacatttagagcaatgcatgggggaagggagcagagcttccatgtcatccctgggtgggccaccctccaggaacatccatgtgttcaactgcccagaagctcactgaaccctgtcctcctggattttcatggaagtttcatgatatcagcattcctccctccagggtatagggtgggactctctcctgagatggtcttaagacccacaaccagaaaggcaggaacataaaaatgaaaaaaggccatgagaaggtgagaggcctgctcctgagacctaacacatccaatattataacaaaagattgtaacaagtgctaggggagttataagccaggaactgtggatgaaaaccaatatacatcataacaccacagttgctgagaaaatattcatggaaaatagacctaaattgatactgcctattgacataatttaccttactgatcttttccttcaccattttaataaatagctcagacagtaatgagtcccattcaaagataataatagaaaagacaccagcactgtgcctgtgtaacatatatttcatgttagagaaaagcaacaaagacaatataatattaaaagacagaaaaaaattatatgccacattgactatcattgaatcacaaagtgagtacaaatttttaatgcattgtttcattaaatcaaattccccttcccgcaccaatacaactcctctgatgtaagtgacctaaaaggacataaataggttttaaagcagatataagataaatgcaatatatgtagtgtgagtttagggaaagataaaagggaaaataccttttatctgagaaatatataccacactagaaacagcaaaaatgaagaatagatattttcaaaatttactcaaataaatgggtataagaaaaaaatcgagcaaaacaaaatggaaaagaataaataggtaacaagggtagaacaatatttatatttgtttgaagacagacaaagctgacctaacatgttaccatgtatattttatccagttttccaattttgtttttattgctggaaggttaatttggtcagagttatttcaccatatcagcaagtataattttccaaactcacaccccttactttttgtatcttattttttatcctattattacatattttataatattatatgttctatactgaactatacagtaaataaaaaataaaatatgaacacaacaatttcatagaaatggtgaggttttttttttaattgaggcagaagttcatgacttgaaaatagaatgatgcagtaaagaaataaactcaagaactcattttatggaaaaagtgaaaacaatttgcaacattaaaataattaatcagaacctcaatccagattaagaaggaatagagaacaaatattaaaattggaaggcaatgaaaatataatcacagatattgatcaagtaattagataagatcattttcttaattttacacaaatatattggaaaccctggattatatgattttttccatatgaaaatataagtgaccaaaatgacaagttataaaatctcagtatcttattaatgcagaaaaagatgttgaggatataaaattctgaacattctcctctcaacaaacagacaccaactcgtcatctagcattaggtatatctcccaatgctatccatcccccctcccctcaccccacaacagaaagcgcactggcatggcacatgtatacatatgtaactaacctgcacattgtgcacatgtaccctaaaacttaaagtataataataataaataagtaaaaacttttaaagaaaaaaaaatcgggatcatttgcttatgtggttactaaggcaaaatgtaagtcatgattttcctggaccagctctgaaaaaatgtcttctctggttaagactgggtaaaatggatgatttatttattcaataaagttattgaatgctcgccatgtgcaagatacagtgttgaatgtggtgcaaaatataaagatgtggaagaaaaagccactgaaaataatatgaggaaacaaaaaactagagtaaattatcagtggaataatttctattatacaagacactacacccaaatattctcctaatgctcatgtaagaatttctccaaaaataccttccagcactacaaactagaagaaaaaagagacatggataccaaattaagttcttaataatgaagaataaaagagactaccttgcctgctccagtggatccagcaaccaccaacagctgtcctctttctatcttgaaatatctttcaggacaggagtaccaagaagtgagaaattactgaagaagaggctgtcatcaccattagaagtttttctattgttattgttttgttttgctttctcaaataattccccaaatccctgttaaaaaaaaaaacacacacacccatcaaaaataaaagatgagtttgtcagaaaaaaaaaacagacaaatcagcaggcatgaacattttcaagaagaaatgtatcaagacatgaaagtactgataactcaatgctgtttaaagttttcttcttctaattctagctatgacaaattaatttgtattaggccatcccacctggcgagaacaattatgaaagctggataaaattaattaaaaataagtagctatttaagggcttctgatagcaatcaaagcatccagaacttgagtgtgtaagctctcagaaagaagagaaacacattgaattgatttcaacattctccacaacctttcatttggatacatttgctgagcagatagctaagaagaaaatggtagctcagagatgttagaaatctgataggcctgcatagacaaaaattggaattcataactatcatggtggccagggcttgataaagggccagtagaaacaaaacaatttcattttgtttttccttcacagcattttctgattctttagttgcagaaggtgagcaactaagaagcttagcataaaatggagctacctgactaaaaggaagttaagcagacctctcagcaaaaggatagacaaaattggagttcaacaaggaacagaggacctagaaatctccctaggcattgagacccctaaaaagctaatccctagctgaaaaggcaaactagaaatgcaccagctgccacaaaaactgaaatctagcctcaaggcatttcagcctgattggaccaagaggatctacctctaagccagaagaaaactacaatttctttggagggagatcccatctaaagactttttctcttaggtcaatgtctggctcttgatcataaataagtaggcatatcagtcagcagggctaaatgatgcatgcacacacatgtgcgtgcacacacaaacagagtgagagtgacagtgagagggagaggagaaatccatagctttaaatgtttccatgtaaagaaaataaaaatacttccaaatatatttatgaataaatattgtatttatactaaactggaccaaagctgaacacatgtgctctcttcccatccctttcccttcgtctctctcatatacactacacaaaataaaatacaggcctattccactaataaatattactgcaaatattctaaagctgtactttacacttaaaagttgcaatcccattaaaaccatacttcataatcaagtagtgttcatgttagtaagcaagaatggatgactattaggaaatagtttactataatttatcatgttaatagaaaaacaataatctccagaaacttcaacatatattaccaactaaataatattaatagaatagtattataatgagatagatgcaatttaatccaaaattcagaatttatgtgatggtgtttgggtacagggcctttgggaagtaacaaggtttagatgatgtcatgagggcagggttctcatgatggaattagtttccttataacatagacaccagagagcttgctctctttccctgcaatgtgaggacagagtgagagaacttgactgtctgcaagagaacgctcaccagatagcaaacattcacagatcctgatcttggacattccagcctccagatgtgtaagaaaatacatttctgtttaaaccactcagtctgtggtattttgtgatgacagttcgagcagactaagacaaataatgacaccattcatgattgttcccatctaccagtcaccaaaacaagttctaacaagattaaagaataaattcccccaaaaggtaaacttaaagcctaaaaattagaataaattgtaaataaagattaaaaatataactggagacaatcaaaaacatatatatcctaaggagattgttaaagctatatgaaaaatgtatgctaaaaatctcattggagcactattcataaatctaaataattgtaaataataactacggttatgttgattatggtaaatccatatatgtttgttaacataatgtggtaatttgtaaatgtttataaagcattcttgtatattagcaaaacaatttgaagtgtcaaattaaaaatcctgaatacaaaattacatgtaagttataattccaagtatgtttgaaaaattacatataaaaataatggaagtaaatgcaacaaactattcatagtagaattttattttacaacaactcaaaataatgaaacaaatcctctggcttacaactttcaactaggtattgtgattttcttactattccattcagtaggatacaggtggcatgtttgtattctcagtttgtcagtgttctcctggcatcattattaatagtgtccctatcactttcacaagtttcctggtttgcagaataaattatatggttatctgagatatgggaaacctaattttcttccttcttccccagtaataatctatacaattctggacaactcacctatccataaaacaatttgatctctaccttaaaatagatatatttctgctacttaacttcatagaaatattgtaaggattaatgaggagatgcttggaaaatactttgagctcatcagagaaaagtgctatgatattgccactaataaatttatttactagcttgctgagtagaaagtcaagggaaatcaagattttgtgggtatcagcgacaaaaccaaatccatcatgcatgttctggcagcccattttatataagttccccagagtagagtagctagtgaacatagaacttctccaaaaaaaaaaaaaaaatatatatatatatatatatatatatatatatgaacatagaacttctccatatatatataatctatatatataattaattagaaaaattagagacacataggctaaattttgactcttataggctattcagttagcagttatgagtaaatgtattgaacttctctttcttggtgaaaatattgtgttccatcaagaactaaccacatggaatgtttggaagttgaacaaagactgttcattaagcttgaaagggacagatgagccagctagcactttgtaacctggcagtcaggcctcaaaatcaagcctattattttagtaggccaattaagttttttagaaactcagtggagaggtggcgtcttcacccattttcagcaccttataaattaggtacttttgcctggcactaaaatatccttcttgaacttaaaaatcaaaatcaataaatcaatctactgctcaggcaacaaagaagcagacgaaaggcaacaatggggcagattaaacttctagcaatgaatcccaaatatacaggagccttagtttgattaagatgacaaaaaaactcctggaggaagggcactcaagtctagctcatggtctctttgttcttcctaaaatctacatcccttgcatcaactacagtactatagtcgacgatttgaagttgaagcataatatcttattttttctgacattacaagtatataacagatcacaaagtttttttttctttttttttttttttttttgagagggagtctcgctctgtcacccaggctggagtgtagtggcacgatcctcactgcaagctccgcctccaggcttcacgccattctcctgcctcagcctcccgagtagctgggactacaggcgcccgccaccacgcctggctattttttttctatttttcagtagagacggggtttcaccgtattagccaggatggtcgcgatctcctgacctcgatcacaaagttgattattttttcacttgtcaagttcttacactatctaaaattcttatcttgacctttcatgtctgtcttcaaaaacaaatcatctctcttcccactctctgccaattggatctctttctctttgctttgttctggaggagagaaaggtgtatctgtattattttcttctttgtctgaattaaacagctgttcttggagagtggtgagcagttctttatgcaaaggagaactggttacttagttttgtacgatttacaaaaaaagtaagaaagtgctgaaaaccagtatcttaaaatattcattttattcaattttattttaattggggcacagatatgagggaatagttttagttgaataaggaataaaaatattttgttataaatcctcaagaatatttataccttagaattgcttttatatttctgtttctatgacattcaaatgggcaaaattttttctagaatttagacagatttacaaataattgcataaatatgtctagaaattgaaaaattaaaagaaaaatacaacaatgagaaagtgaattgaacttgaaaaataccctaattgtgaaaaccaaactttcatagtattattttaatgttttctgatttgcattttgggaattcttgccttcactgtgttcttttccttagattttctctacatactgttcacaaaattcagttaaaaactattttagaggttgtctagggaaagggctgcatgctcagtcattgactgttacttactttggtacaattaggggtattaaatttgaattcactggatttgtgcttctccccacacaggctgactattcgtagctgttgctgcttggaatacatattggcttaattaatcagtactatttggaactctgtgaaaatgcaaactaattatgaactttctctgataagagacaattttagctcctgattatttgcttttccctacatttatataacagcaatctcatgaaatcgagcattagatcagcatgttattgatttgcactttaggcaatttgcacctctgaattgctttcctttctgatatcttcagatgcaaaatcttgaaaaagagcttacagtcagacctttatttgattgtttgataattgtttttcctctctgtttccattagcattatttgtggaagaccatagcagtgggagttcttgtcacagaaatcttgtgacctctgtgtttggtagctatagactgcaatgagtttatctcttcataggggaaattgagaagagattactgctacccactacccaagctctggttttctttacaaagcttctgcataaatcacaactacatagcttcaatgacggacctaactcttgcttggaagtgtggcagcagagttggatttaagagtcatggatttaagagcagagtcatggatttaagctacagtcttatcactactttatttatagtaaacactctgggggagacttttagtgctagattctgtgctagactctggtgttgaaatatgtgtcagctatggcctcagctctcaaggcattagttgtgtttgtgtgtgttgtgtgttttgagggaggtgttaggtgttggttgaaagaatgaggaaggggagcaagatttgaggagaaaacaaacatgcacatgtacatggtttcattgaataatctgcacttctgaattgtcagtacatccatctgatttagtgataattgaattagaatcattctgagctgcggtggaaaacattgaatatttttttcacactgaagccagaactcttgggtaccataacccagcaatattgtttgctggctgtcacttaaactcacaaaactcctctgttttgtcatctgtaataaatacagatacaatattttgttttatatatatgtatatatcttgcaaaattattgtgatgatgaaaaacgaaacgtaatacacacggaataatgcatagtagatgggaagcactaaataaatggctatgtaagcagtgattcctctctttgttatcttcattattacaatttctacataggttttatttcagtgatttttatagtaatgactttgcttattttataaaaatacttcatgccaaagagtacaaagaaaacaaaataaatcaccccaaattttcagaaacaaccaatattaacagttggtggaattcatttgggtgattttttttgtttcttctttgcactttttggtatttttcaagtttaaaaggaataagcacatacaattattataatagctgtaaaatagttatatgtgtttcaaatttcatactccaaaaagtttggatatagatggaagatacataactatatgtatagtgagagagagagagctagcagaatagataaaaaataattttataataaaagaatactatatctgcttttttaattggaagtattaaatttatctatgtgactgcattatttcctaaaaggtcacatttttttaaaaaaattaaaaaatattagaagattgcatcattataatttatttcttaaattttaattatatgtatatctatgaataatttatgcataaacatatacatgtaatgtcaaatcctaagaaaatgtatacaccttaaggaattatcacaaaacaaacacctccataactaacactcagaataacatttttttgcaaaatagattactactccttcatttgtcttgaaagatacctactatttggagtttacttttcttaaagttttgatatttatatacccactctgtggtaggccaataatgcctctgaaaggcatgtccatgtcttaatccatggagcctgactttatttgaagtagggcatttgcagatgtatttaagatatttgaggccgggcacagtggctcatgtctgtaatcccagcactttgaaaggctgaggcaggtgtattcacctgaggtcaggagttcgagaccagcctggccaacatggtgaaaagcccgtatctaccaaaaatacaaacgttagctgtgtgtggtggtggcggcacctgtaatcccagctactcgagagccagaggcagggagaatcacttgaacacaggaggcggaggttgcagtaagccaagattgcaccattgcactccagcctgggtggcagagcaagactctgtctcaaaaaagcaaaacaaaacaaaaaataaaagaagaaagaaaaaagaaatttgagaggagatcatcctgggttatctgagtgagccctaaatgccatcacaagtgtccttgtaaaaaggagacagagggagcagaaggcaatgggacaatagaaacggagaagtttgaagatgctgtgatgctggctttgaaaatagaggaaggcccacaggatggaagaggccatgaatggattatcttttggagtcttcatggagaatttagcccttctaccatcttgactttaggtcagtgaaacaaatgtacttctggtctctctaactgagagagaataaatttatcttgtttaaaatcactaagtttgtgataagttgttacaacagccccagaaaacaaatacacactcatttattttcttttattgcataacattatgcattgtgagtttgacctatgttgttacatgtagttctaatttgttcattttcattgctgaataatattcaataggcaattttaaaaattcatctttttttaaacaaataatgctgctatgtacatccttgcttgtatcttgtggtataaatatgtaagtgggtagctgcatccatttactttttctccaacagtctatgagaatttcccttgtactgtatcttcatttgtaatagttattgttagtcttttaatgttagacaaactagtatgtgtagaatggtatgtcactacagttttaatttaaatttctctaacaaataatgagccattttcatctggactgagccttgggtgaagcaagagaggcatctagggtacacaatttaaggacatgtttaatccctttcctttctgtccttgtttgtgatgaattatttctactttatcaaacaaaaagtgtaacaggtatacaattgatttttgctttttgtgcatttgttataaatccagtcaccttaccaaactggcttttatttctaattgtttgtagataattgttgacatttgtacataaccatgccatctccaaattagcatttacctttccttttcaatatttacaaatttaacttcttttaattgccgtatcccactagctggggccactataaatcttttatacttgttttgatgtctatagaaactgtagcgatgtcctctcctttattaatttctcacactggtaatttctggtctttctttctgtctcactgtttatctttctgtcactctcttcccctctttctccgtgtgtatgtatgcatgtgtgtgtgtctgtataaaagaatttaaatatacggatagtccttgacttaatgatggtttgtcttacaatttttcgactttacaatactgtaaaacaatcacaatttcaacataatgtaccatattcaatacattacatgagacgttcaacactttctgataaagtaggctttctgttagataattttgcccaattttaggctaatgttagtgcactgagcatgtttaaggtaggttaggctaagcgatgatgtttggcaggttaggtatattaaatgcattttccacttatgatattttcaattatattgggcttatcaggatgtaaccctatcataaggtgaggaacacctgtactctaattatgcaattataaagaggttcattatttttttccaggcaaaacttttctttgttgattttttctcttatatgtgtgttgtattagtcagttttcaaattactataaagatactacctgagactgggtaatttataaataaaaatgatttacttgattcacagttctgcatggctggggaggcctcaggaaacatacaatcatgaccaaaggtaaaggagaagcaatgcacatcttacacagcagcaggagagagagcaggaaaaactgccacttttttttttttttaagacagagtcttgctgtgcagcccagactggagtgcagtggtgtgatcttggctccctgcaacctccacctcccaggttcaagtgattcccctgtcttaacctcctgagtagctgagattacaggtgtgtgccactatactcagctaattttttttgtatttttagtagagatggggttttgccatgtgggccagctggttttgaactcctgatctgaagtgatccacccacctcagcctccctaagtgctgggattacaggtgtgatccattgcgctggacaaaactgccacttttaaaaccatcagatctcatgacaactccctcactatcacggatagcatggaggaaaccacccccatgatccaattacctcccaccaagtccctccttcaacacgtggagattacaattaaagatgggatttgggcagggacacagtgccaaaccacatcatcctcatttttttcaataatttcttcatcatatctcgtcatgtatttatttacatgtatttttaaattgagtactaggcattatatatgaaaaacagagtaatttgaggccctggaaatgttaacattctctagagaggaattacatttgctctttgcagtaagctaaggacactagcaggttactttaatgcatccataagtgtacagataatcagacactgggtttatgtccttgagtgggctgctctttatcgagtgtagtccttgcccccaactcaaagcctggagggtactgtgctccaattcttcccaccacagtcccttgcacactcacagttacatgcatttcactgccaaaagtattccttagttttgcaatctattttttaacttcctagaatcagtaaaaatcttgagctgaaaagtgatgctcaatgccaatctcatctcttggatctgggctttgcaattttccattgctttgttaacacttagtgtctcgaagaaaattttgttgttgagttccatgggagagttgatatcaattacaaatctgcagttactggtagaagttcctgtggtttctattttaccttcagattttacttttagactgctccagtctacatctttttataagagatcatgtgaggacagtttttttttttaattctcttctgcaacctctggagttttgtaacttgcattattcttgttttagtaaaatttatgcctttttttctatagtctgcaagaagttttctttagttgcttaatctatgtgctgtatttataggacttattgttcatctgtcatttcataaaatgtctctttttactttctccttattttggctcattctttggctagatttttggggtgatgttatctgagatctcttatgtctatttgttgcttgaatgacccttcaggttttacataattttttcagccattcttttattttcttaagaatttcctggtaacatatttcccctataaatctacatccaaatccttccttaatttaaggaatcactacatgatagtgaacgtttaattctcttttattccaatttgagttatcaatgtcagtgccaattattctttttcaagatatcattgcctgcactcttcacgtattatcttgtttataatgacttgaatcatttttgtttattaacatacatagctacactccccccagaggaatagggaactcacatatgcaaaagaaaatccatgggaacaccgacaacacaatttatccatcatccagtagtactgagtaaaggctcttggaataagaattttcaacacaaatagaatatgaaaaactataatatgcatacaaaatgtgataggacttggacgtttaaaaaatgacttctagttgaaaactaatgtgtagactagcagaaagatataggtggaattgatgagcataaaattattaaataaaaacaaaaaataggagtacatgataaatattttcaaagtatgatatctgaaaaggctaatacaatacacttttgacaatttccaagaaaagtagaaagaaagaagaaaatttttaaaagagataaagatactacacctacagatatgaagaaattttaaaacctcaagctgtagtcattaaatatgattattatctgaattttaaatgcatgcactctttgactcaccctttgactctattgttatcatctctagcagatgctcagtggtctgataggatcagtaacaacacagaaccattgccaagccacatggaagcatgaagcaaaagaaaacctcagtaatattttgtctttatttaaaatgttaatatgttgttcatcatggatttcctgcattaattttgatttaataaaatattacattatcatttaccttgattactgagtttatttgacatccatttagtttcctcacctgaggcagaaagggcatcatgttcttcactctgagtcaggacctgcacaagacctaaaaattttacatttatgtccacttaggcagttgaggtcttgccttctaaatttctctatagctcaccacgaagaaatggtgttgatgtagggagagggatacactctcgtagtgctagttccaggaagatgcccatgtgcccctgatagcactacggagtttagcaatttctgccttcactgcttattttactttttctcttcctcagtttgtttccattccagagagccaggtcatgggcactggaactagacaaataaggattgaaaacccacttatgtaaccttgaatgagttattttacttgtctgagtctcaattttcttatatattaagtgaggataatttttaatttataagattcttgtataaataaatatgtacagaaagtccatcatacacctagtccacagcatggacttaataaatctcatttatcttttcaactctatttctgcttcccattcttcaacttactactacaaagctaatccatagctagtatatagtagaaactaaaaaaaaattgaaatgcatttcttttattgctataatcacaaatatgttacatagacctacctcaatgctagagttcatccattgagttggttcagttatgtttaatattagtttaatatttcaaacgtagcaaaaatagtttattatttacttataatatgtggaggaaagtaatcaataggcttcttagaaacactctgattcctgatcgaaaccccattattcagtgaaattgttttgataatgtatacaatttcagaaatttatatttttgcttctaaaatctcaatgtatttagttaagagaaataaaaataactttagctgactttataatatataaagtttattttaaacctttgcctttaaatgaaaaaaataatgttattagaggttttatacttttctgtatgtaacatcaggctaattttcactagactgtaaatattctaatatggacaggcaaatcagtactgaatatacaatatattttcttttctatggatggtgcctaaattacatcagtttagaacaaacacgcttaattaaagccaataaattcaggtcaccaagaaaatgtttttacattttaaagagttttaagatttgttatttgagttagtgtcctttgaataatggctgagagaacagtttttttttttcaattacacaagtatttcttcatctatttagaggctctgaggtcagactagattaaaaacgcacacacgcatttgtctgaagtaatggtggaaaattacctccttggtgactgtagtgtgcaagattgtgtgcggtttggtttctaatctttcatttctttccaacatgaaaaaataaccttcctcaggcaagaaaaaaacattgtacttggggagttgcctttgatcaaagaaaggggtaatagctctttcctgaaaatggtgacaagaatgaaaaatggaaagaaagatctattttaactagaagtaatgattttgggggaggaatagggagagtatatgtgaggaaacaaggaaggaaactgagagtaacagtcactgatgccagtttgtgaaagggatgaggctgaccaacatgccttgaggccatatcagaaaattttagttttcatataaaatatttacatttccatctttttttcctatattatgagggtaatcaaaagaagaattttggctttgtacagaattttcctacatattgatgaagtaaaaatgccaagtatattcacattttcaaggttttactgagaataaagtttatacctagaaatgattttaatacaagcaatgggctatcctaggaaaacaaaacggagagagatggtctaacaggaatgatgtagcagaattaacataaatgctgctatgctttggttctgtgtccccacccattatcacgtgttgagggagggaagtgataggattatgggggggtgggtggtttctcccatgctgttctcgtgatagcgagtctcacgaaatcttttggttttaaaagaggcagttttttcctgtgctcctacttccctctcttctgtcaccttgtgaagaaggtgcctgcttcctcttcaccttccgccatgattgtcagcttcctgaggccaccccagacatgcagagctgtgagtcaattaaacctctttccattataaactatccagtctcaggcagttcttgacagcagtgcaaaaacggattcatacaaatagaaaagatattatcaatttcatcctccccagaactttcatgttttcactagatttatgagatatatttttcaatctccttgaaaatcaacacaagcccttcgttatccagtctcattataaaataaagtatttgttttatattggcaccatgacaatttcaactaaattaatggcttcagcaacataaattattatctcacacttctgcaggtctgaagtctcagtgggctcaaccagctcccctgttcaacatccggcaaggtccaaacgaaggtgacaatcaacagggatcttattgggaagctctggtaaaagtacatttccagatttattaaggttgttgtcagaatttagttgtttgcagttgtatcaccattcccagtatcttgtacagttgtacgtcattgttttcttgcgtgtgtcaactggtggttgctggtgtcagctcctagtaacctgtctccagtcttcctatgtgagcctctacatcgcaaaaccagcaatgacgcctccgaaacttctcaggcagaatctttctaatttctccctctgccaagcctctctttctccagctgaagtatgttctctgcttttgaaggtttatatgattagattgggttcacctggatacttaaagctgcttgccctatcttaaggtttgtaaccttagttacagctacaaagtccattttgccatattcacagattccaggaatgaggatgtggacatctttgggaggctactgtgcataccgcaaatactaatctcacaataatctgtttatatcctatttttggccattaattcactgaaattcatactctgcattttgttaagtattcactctctgagctgaagcacagtaatacagaaaaacctagatgattcaaaatgaaaaacattgatagagtaaaaagaacatcagaaatcattggtttttgagactaatgtgcgaaagtttacttttccatattttttgatagtatttttccttgtttttaattttggtatactttagataagatgaaatgcacaatttttaagtcattattcaatgacttttgataaaaatacatgattgagccacccaaagcccatagaacattgacattcccccagaaatttctcatgccacttaacaatcaattcccgtcaccctccagccattattcttgtttctatcactacagattgatcttgccctttctgaaactttatatggatgtgatcatataatacatacttttggtgtcttttttggtagcatttttgagtaattttcaattatttgactatatcacagcttttacaacccattttcaaattttgcgggcctttgagttctcttcagtttggggttatcaagaatgattatactgttatctttatttctgttaggcttgacaatatttcataatcatgtattctcagaataatttgcaatttatttatttaagcagtcttactgatttttaggtaaatatatttttgtatttaaattttagggtacatgtgcacaacgtgcaggtttgttacatatgtatacatgtgccgtgttggtgtgctgcacccattaactcatcatttgcattaggtatacctcctaatgctatccctcccccctcccccctaccccacgacaagccctggtgtgtgatgttcccattcctgtgtccaagtgttctcactgttcaattcccacctatgagtgagaacatatggtgtttggttttttgtccttgtgatagttggctgagaatgatggtttacagcttcatccatgtccctacaaaggacatgaacttatcattttttatggctgcatagtattccatggtgtatatgtgctacattttcttaatccagtctatcattattggacattaggcttggttccaagtctttgctattgtgaatagtgccacagtaaacatatgtgtgcgtgtgtctttatagcagcatgatttataatcctttgggtatatacccagtaatgggatggctgggtcaaatggtagttctagttctagatccctgaggaatcgccacactgacttccacaatggttgaactactttacagttccaccaagagtgtaaaagtgttcctatttctccatatcctctccagcacctgttgttgcatgactttttaatgatcaccattctaactggtgtgagatggtatctcattgtagttttgatttaaatttctctgatagccagtgatgatgagcatgttttcatgtgtcttttggctgcataaatgtcttcttttgagaagtgtcagttcatatcctttgtccatttgttgatagggttgttagtttttttttccttgtaaatttgtttgagttctttgtagattctggatataagccctttgtcagatgagtagattccaaattttttttcccattctgtaggttgcctgttcactctgatggtagtttcttttgctatgcagaagctcttttgttcaattagatcccatttgtcaattttggcttttgttgccattgcttttggtgttttagacatgaagtccttgcccatgcctatgtcctgaatggtattgcctaggttttcttctagggtttttatggttttagtctaacatttaagtcttcaatccatcttgaattaatttttgtataaggtataaggaagggatccagtttcagctttctacatatggctagccagttttcccagcagcatttattaaatagggaatcctttccccatttcttgtttttgtcagatttgtcaaatatcagatagtttagatgtgtgtcattatttctgagggctctgttctgttccgttggtctatatctctgtttttgtaccagtaccatgctgttttggttactgtagccttgtagtacagtttgaagtcaggtagcgtgatgcctccagctttgttcttttggcttaggattgacttggcaatgtgggctattttttggttccatatgaactttgaagtagttttttccaattctgtgaagaaagtccttggtagcatgatggggatggcattgaatctatgaattaccttgggcagtatggccattttcatgatattgattcttcctatccatgagcatggaatgttcttccatttgtttgtatcctcttttatttcactgagcagtggtttatagttctccttgaagggtccttcacatcccttgtaagttggattcctaagtattttattttctttgaagcaattgtgaatgggagttcactcatgatttggctctctgactgttattgttgtataagaatgcttgtgatttttgcacattgattttgtatcctgagactttgctgaagttgcttatcagcttaaggagattttgggctgagatgatggggttttctagatatacaatcatgtcatctgcaaacagggacaatttgactttctcttttcctaattgaataccctttatttccttctcctgcctgattgccctggccagaacttccaagactatgttgaaaaggagtggtgatagagggcatccctgtcttgtgccagttttcaaagggaatgcttccagtgtttgcccattcagtatgatattgggtgtgggtttgtcataaatagctcttattattttgagatatgtcccattaatacctaatttattaagagtttttagcatgaagggctgttgatttttaggtaaatattttttgagattacctgcccacaaacataaactacctattgagccctgcttgtattttgatgggcatatgcacatatacactcagagttgaatgtggctactttaaatgacttctgccattctcataaaataattagcagattttccagtttataaacttgatgacattgctatataagatactggaaaacaaattccattatataatatatgcagagataagtttttggaattgataaggcacttttccaggattttttatcctagatacagttgtttggataaggacattcttatagatagctggcttcataactaatacaagcaatttatcataacatacccacagttaatttttttcttcacttttgccctacaatgggtgctcttaaattcctttgtaatatctttaaaggtatagaaataagaaatggaaagaaaaataagcctgagaagactttgggctccaaaaatcttttctcttggtaaccatagcagctcgtgactcaataaagtgataaaaagacttcatattttggggttaaaaaacttgtatatgttagtttttctgacaaagataatcagatatgacaattactaaatcgggatattaaaactatcatctcaggataagaacaattacatattttcctgttgaaacattagattttttgttgttgtcattgtccattaaggaaaacctatctgttcttgtgccccagtagcactccacatctttggtagatgtgagtttatattttttatcactactcttgtgcttgaagagcatgctttaacattccttgtagtgcttttctggtggtaataaactctttcacctattattttaaccttattaaagtgttaattttgccttttgaagattattttcactgaatatatcattctgaaatgacttattatttattctctatactttaaataatttttagattttcatttagcttatatttgttctgatgagaagtcagaagtattttttatcattattcccttttctattacatgccttttctcccacctacaattatgaattttaattgtatgactgtgttgatattctacatctctccactgtctttcttattttcctctaaatccttggacatattttaataccagcttaaaaatgcttgtttttattcttaacaacatcctggctatctaaggtctgtttctattgcttatttatctcctaattttctcataggtttctgctatttttgcatgtttaataattgtttttgttttatatttgacatttttcatactatattatttagattctagacttccgtctttggtagaagtgtgttgaattttattttgagcagacagttaatttactggcacattagtttgatccagttggtgcttatttttaagtttttaaggctgatttaagagtatttcttctgataggagtagatgagccctactttggaagctgacttttctgagttcttatttaaacactgggagatgctcagtgagtcttttcactttgactggttgaaactctaatggctttcaacattgatgaaccagtgaaatcctcattccgctcatggccccttagaaactgttctctgtgtggctttgtgaaatcttactctgtacatgcataatatgttgttcactcaaaaaattcaagaagactcatttgtagatttttagatctctttctcagttcgactctttcttctctggaatgttcttcataaattccagccacctcagctgcatcctataataggtttctccattcagaaaaattgctgtgatctatttgggctcctctttcctttcctgcagtttggaagtatccctatataaaaggccagctttaaatgtggagttcacttcaaggatcatgactctatgctgtgtgttgtacaatgctttaaaatgggcacatggtacattttgtctagttttatagttgtttacagcagaagattcagtctgaaatccattattttattatggccagaaccagaagtcaagcactctgttttttgaaaagcacatattgtgtacctgctaccttccatgtaccataccaggtgtgttcaaatacatagtcaagtcagcttttactatttgttgttccccatgaagggcttacattttattttattttatttttcagagagagagcttaggcagattgttattcaatatctatgcatttgctcatgctgactatttctggtatatttttacatacttcctaaatactgtttgtcttgcaagatttatggcacttcttttttgcatgtttttctaattcatctccaaaatcaacctttctcaacttcatttgttcataagatacttttaaattcacctctgttataacatttaccctgttgaattttagttatctctgtatgtgtcataaaaacccagcaaaattttaggctgcaactgccacttcctctctttgtgactcagcttgtcacagttacaagtgcacatattaggccatttctaagagttcattgtactgaatacatgctacctaatttaactcacataataaccttgtgaggtatatagtataattatcattatgtttaataaatgaattgagtctcatataagttatttattctagtttactaatgtcagtgatagaactgaattctgagttcaagctccgtgtttgcaactctaaatctactaatcatcactataccacatttatcatgcattgccttcactcttgttagcctgacaaataggaaaataataaaataatccttaaatatcagtactatctcatacaatttcatataactcacacaattttaatcacaattgaaaaggtctatacagcttaattagtctaactccccattcaatggtcgtattttctctacggtattcctgaccataagactttgttttgaccctgctgtttgtgtcccccatcccttaaagcaatccatgtatgctagtaattattaattccttagagtagtttacatatgccatcctaaaacttgtatccaccatttctttctccacccttaatggctgtatacaatttttccccttggtcattcattggcaagccctcagatatttgaaaacaactaatgttgccttaagtcctctttctttcaaggtaagcatctttagttgcttttctttgctcttcttcttagattggtttctactgtttacatcaaatattttctgtttgtggacaagattttaagaaatgtaaaactatgaaacatactgtcctgtatgatcatactaatctgtgaggttattataatcttaggtgttattacaaagcttttactttccctttccaagatgaacaacacagcaagatgaataaagaaaattttccctctagtaactagaagagttagataactatgatttacagatgaaaacctagggccagagccttcctgtaggatattagacttccttttcaagacgtggccccctatataatgtttttaaattatctgccctcttccttcaattctgtcactctgttatgtcctttgaaaaaagacagtgaaggagttatatttggaaatatgccccatattttttctgatcactagaatgcagaggtggacatgaattttatgagtctgtagagttagggagtaaatattttaagtaattaattctacaatattaaaaacagctctcaccataaatcaacagctgaatggtgggagttggacataatggagaaaatatggactaaagagattatgaataagtattgtagagaatccatattttaattgggtgaattaagtaaactcttggatggattaaaaggttagattctggttggatgtggttttcccttatgttccagaaatatgtcaactcccgatttacaacaaaggcccaaattcacaaaaggagaaagacacctcctttcctacctattagaagaaactaatattgccatcagaccatccatatgccattattattttatattactcagattataataggcagtgaactttcaataatatatcacctgatcttttgttgtttatatcagaaaccagtaatctttctctgataaagagtatgagcccatgagcccatatacctgacaaatgtgtaaaggcaggagcagtgcccaggtgtccctgagaagcctatctctgccactactttcttagggccgcagagggtacatatctcatgcaagcacacacttgccctcacgtgtgtgcatgtttaccctctggattagcccaattctccattcacctttagttttgcctcatattttgggagttcggattagaaaactgatctaatccactcacatttctggcatctctaagcttatatggtatcaatgacctcatgatcctttagatttatttttaatatctgagtatttactttcaagggttaattaaccttggtgaaatcttaaaatcttcagctaaagatatactacatgacaggcatacaactttggaactgctttgctatgaacctacacaaggtaaattggcagtggtcacatattaaagtagctgcttgaacaaaccttaatagcacagctttcatctcaggacttattaagatccagtggttgcttagagataaattagtttgtttgctataatttgttgaggaaatcaccatacaatatgccattagagtgcacatatttcttataagatacctgtggtaaagctcttcctgtcatcctaaactggagaacgtactgaaattagcttcatcatgaaagtttagatgcagctgaaaattcagagacaattgctttatcttaaaagctattttcacttttccattgccacatttaaaagttaaggtttatagagaaatattctcaagtgattatggaacaagtgcaggaaaatagaaacataaaaatatgtatttcaaggcatcaattctaattctgcttctaaaaatagtcagtgtgcaaagctgcagttgctggggtattgcttcaatgaagctgcatagtcaccatcaactacattttcaggacccacaatcttcatatatatactttattttttaatattatagagaaagacagcgtaataatttggtgggagcttccccctatgtatgatataggaaggtagacaaattagcatctgcccgtgctatgatgatcacaggaacaatcttgcagctgacaatgccaagaaattactgtccttgaataacgtcaagctttaaatttttgactactgaaatttcagtaacaaatattgcaatcaaaattgaatttcataaaactttggattcattttacaatagtaatattcagcttcaggtgaataatgacattgatactcagcctttcagtgttcagccaaatatttatttggtgcgtctctactttatatatatttgcagattttaaaatattttttctgctgtgtatcatcataactgatacatgtacacaaacatacaaaatctttttttttttaatttttttttttattatactttaagttttagggtacatgtgcacattgtgcaggttagttacatatgtatacatgtgccatgctggtgcgctgcacccactaacgtgtcatctatcattaggtatatctcccaatgctatccctcccccctcccccgaccccaccacagtccccagagtgtgatattccccttcctgtgtccatgtgatctcattgttcaattcccacctatgagtgagaatatgcggtgaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcggagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaacatacaaaatcttatgaaaggcaaatgcaaacatatacacaaagaacttattataggaaaatgtgaaaaaataaaacattcaaagcagagatcattacataagatgacaaaactcaaactaaacatatcttcactgttatatgtaatgaaataaaattaataattaaagcaaaagacttatattggacaagaaaaaatgtgttgataattctgttagctccacccaaatcgtttatctgactttcagttctctgttctgtgctccaggaggcgaactcccaagactttatcattcaggttcctctgccagctagctcctagttgaattggattaatgtaaggcactggcagtgggtcagatggcagaaagagagagagagaaatcctgatatctataccctgctttcttcctaattctgcatgaatgtagtttctaccagataactcttctccacagcaccagatctttctaggcttcaataatgcaaattatatactttgtcccttcaggtctagggatggtaacagcgtttcattgttcctggttgtctgagtattacagcaacctttgctggggttttaaatcctgctctaactgaggtaagtagtccattcaccaaagtctctattgtggaccattgaagcagatttctttttcttttctttcttccttttttaataatagtgatggggtctccctatgttgcccaggatggtcttgaactcccaggctcatgtgatctcccaccttggcctcccaaaatgctgggattagaggtgtgagccaccataccaagcctgaagcagatttctgttttatacaagggtcctaattaatgtagaagctattacaaaatggggtatgtaagaatatctctttcttagggaataacaggtagctataccttgtactgcctaccacacagaaagagcagagtgactgagaggcttctctggattttggaagtaacatgactacagttgtgtgtattcaaacctattacaggctaactcacaagtctacccatttagaaaaaagagctctttgcagcaggttcagtctgtgctgtaggctcctctgctgcgtgggtattttgactcagtagatctaagtatctggcttagagtaatgctgtttgacgcttctaagtaaccccaagaagacaatcatagttcacctaactaataattttggaacaaaactatgtccccttctgccaaatatttttatctatttaagaagtctggcttgtcaccatgtaactatgtgatttgaagggttcacaatcaactgggtgctatccaagttatcaaatcttaaaattgtgcttgaaaattagcaggttattataaaatggaattgatatgggtgacattaaggctgaacaggaaagggagtcacaagtatattgaatgagcaggtggttcagacctttattagctattcttgcttagttatcaaattttcctcaactctcattcatattcaccaggggaatcccctaaagagaaggtgctcaacaatcaggtagattaggtgtctaatctttcctgtggatgtctatcaagctttctcccagtgatactggtgcttacttagtggaaccatgcaaaaagtaatcatagttgcatggatggtaaatatgcatgaactcaacacaatggactaccctttagcaaccctgatctgtctactatcactgagtgtccaacttgtcaataccaagggccaatgtgttcctgatatggcaccatttcatagggacaccgaccaggcacctggtgctagggtgattacattgaatcctttatattgtggagtaagcaatcatttgtccacataaaaccaaatacacattctagaaatgggtttctcttctctgccatcaatgcttctaccagtgtcaccatatgtcaccttatagaatgccttattcattgccataacatcccatactacattgcctttgacaaggaaactcattttatagcaaaacaattgttacaaaagatccatgcccatgaaattcatgtttccccacatgtcccatcaccagtaagcagctggcctgatagaatgatggaacggctccctaaaggctcagtttcaatgccaggtgtgacacaatattgtttgaaattgtggtgctggcctaacagattaaactattagccaatacataagccatatttccaaaagccagaatatgtaggataaggaacttagaagtagaattattttacctaatattcgatttacagaattttatttcccttcctggaaacttgtatttagtagcgttttaggttctcttttccgaggaaggaacatttctttcaagaaatatagctatgtttccattaaatttggacctgaaattgcactcttgctatttttagctcctaatgccattgacctaactggcaataaagagtttaactatactgaatggattgattaattctgattaacacaggaaaattaggcaaataggcctagttggaatccaggagatctgctgtggagccttttagcacttatatgtcccataaagagccaccaaataaagacagtatcactagggactttgatcctatgaaatgaagatttgggtcatctcatgagacaataattcctgtactatggaagtagtaaaatttgcttgaaaatggaatggataatagaaaaaggaaattatgatgataaaatttaggctcatgaccaaaagtgaaaacagtagtagctaatttacatatttatgttaactgaatatttctttcccctcactctccttgctagctcatataaagagtaccgatagtgggtgacattaacatttataatccagttgggaataagactgaattgctgacaccctgccacaatttaaattatgctagaactgtggtttccctgtactggagatccaattttcttaatctaagcaagaggcaacaatgaatgagaagtcggagtaatgttctggtaagtttttattgacttcatggatttattttcttcccttgtctaacttgctctgtgctcatggatgcagagccatgcagtcaacatcattcagattcctttgttgcctgaatttcagcagaaggcactcagtgggaggctcctctagggttcaagttaggtggagaggagaatgggttatttattccccgattccctctgctttggttctgtgcttctgccaggggctgaatctctccataactagaactcgtgctatgcaacctttccttgcagctccagaactcacttagctctggtaatgctatcatttctcttgtccttttatggcttcctgtggttggtgtctttgttcctctgcatctctctttctctcttattttttttaaccctagctacatctccataaacagactctttaggttcttgacagtggaaactctgagaggaatcatgattccttccaggattacattcagtaacaaagccaatgatttattgcatacaagcaacaactctaataaaaattaactcaaaagcttgaaagtgaagctttgggcaaaagaattacaggcaaatagaaattaaaaaaaaaagcaaagatcacaatatttagaacaaataggttttattcatggttggtaaaaaatatgaaggaggacaaaggcactttgtatcaataaaaaggtcactataaataagtaactgtcataaatatttattaaatatgtatgcaaaattcagaaaacaaaaacttcagaagcattttttaaaatacaatttataatactattttttcagctgatgaaagatcaagtgaaaaaacataagtgagatttaggaggacataagcaattaatggaggataactaatatgtgtatatttattcaaatactcgtggaataatagtcaaagtgaactaagtattgggcctcaatgaaaaccttagcatattccaaaaagtaaaaatagtgtataatttagtccatgatgacaatgtaataaaactggaaattatttctgggaagtgatattgcctgcaattgttaatttctacattttaaaaaataattattctgttattttgttcagtaaacattgtacttttttataggtaaaatatcaaaatactcaaatatatacaaaaagttcataatatataattttaaaaataccatacaaatatcaaacttagaagaagcaaaaacaattgtagctgtgctaatagccctcagtgagttcagaagtttataattagatattaaaaggagggtaagaagtacatgtatagtaactggacagtgcacagccacaagttgggtatagccctataaattgtctattttaaagtatacatatatagtaatttgctattcagaaatgttgaatcatttaaacataattttattattacagaaacagtatatgtacatcagagaaaagtttttaaatgcagaggagcaaaatgtgttgacatagtcctataaacaagaaagcaccattgttagtacctttgcctctagccttacatattatttttcatcagatatacactttgtaacctctttttcagtcaataattttcatatttttattttcatgcattttcattatatataatgtccatgctgtatttagatgtctttaattaattaaacatttttctttatggctgatttctttaaaccagtctcagtgcagtcctgcacattatatctaattgtccaccccttaattttttttttgaatccagaattacccccctttttaaatggtactgacttgttgaaggaaagaggccaattgacctacaaaacggcataccttgaggctttgcttgattgctttctgtgtctaaatttacacctaatgccttaatggctgccagctaaacacgcttgactagaataaatcacaggtgaaattttgtacctgatgttgtactacatcagaaaatttgtaatgtcaggtcgacccacagttgagacagtaaaagtgatcattggtttgtatgatatctgatatctgatactgatgtcatccttcagttagattgccccttttgcaagtatggtatgctatgaaggtctacttccccataagccttcacttaatgaattttagcagcaatgtttctctttcataagcttccactgaaatataatataattgaattgtgcaaatcataattgtatagctcaaggaattagttcagagcgaacacacccatgaaactatcaacctgggtcaagaaacactcaagggacacataggaggctcctcatgccccaaccacattatttccctctcccttctcccaaagtgtaaccactctcctgatgttaaatggcaaagaataatttaccccctataaatagactaatacagaatgtgtttgtatttgttcctcttgttcaaaattatgatcaagattcacagatgttattgtgtgtatctttatcatattcattttgatagatgtaaagtagtacaatctattcatacaccactatttattctttcctgtcttgctagactttgctttccttctgtggctaaataatccatttgtgaacattgttataagtttctattactgcatatgtgcatacaattctgttgaatgcatacccagaaatgaaattcttggatcatacaggacgcatgtgttcaaatgttgtagataatatgaaacttgtttccaaagtggttgttcgaaattcatcctgatagcataagagatttccggttgcttcaaaaccacatcaacactttaaattattttctatcttttaacttttctggtgaatgtatagtatttctcccgatggacttaattattatttaaggacaagtgaggttggatgtcttttaaaacatttattagatatttgtataatctcttttgtaaactgctttttcaaaatatcgcccatattcttattgggtggactctcttcttattgtttgaatttttatgtattctgcatataagccatttgtcaattatataaaccacaaataatctagtttcatttgcttttgctctcttattggtgcctttttagagaagaaaacactttttaattttaatacagttgaaatcattaatgtttttcatatcctgcttaagaaacctttgcctttccaggccctgaagatattctttattatcttataaaattattgcttttccattcctatttagagctacatgaatgaaatggtgaatgaagtgaggtaaaagtctagatttctttttccatactgatacaagattctatactgttatattggtctacctatgcttgtgatatttacctttcttcattactatggtttatattatagccttgatatctgggactgtaagtactttgttcttttttgagatgttagctgttcttagctttttgcattgtcatctaaattctagaattcacatgtcaatttttgaagataaagaagcctcttggaactatgattgatattgtagtcaacagatgaatttaggaaaatgaacatctttataaatttaagttttcaatttatgaacacattctatctcttgatttatttaggtttcattcaatgttacccaataaagttatatagttctgcagagattttgcatatatttaattaaatttatctcaagtatttgatgttttgatgctgttcaaaggggtatcttttttatctttaatcttctatttattgtgtaaagaaatacactttttaaaatattgatcttatatcagaaaccacaaaaaactgtgatattaattctaataatcaagtagaaaattatcttggacatttcataaacacaaatgtatagtgtgaaaataggagtggcattttacctttctggtctttagtctttactccttgccatcttgcactggcgatgaatggattagaataaagtgggatggggtaatgataataagtaatctagcctcatattttatcttacagacaaaatgtttaacatttcacattatgaaggattttgctgcagattttttctttttttgaagattatgtttatcaattaaaatgctacagtttgctgaggttttcaattctaaaacatactattatcagagattttagacaatcatctgatttttctttttattcagtagtacattgcactaatagacttttaaatattttgggcaaatttgagcagaaggaggataacctttcaaacacgaaagttgcaagaaaagtacaagaaaccacatagtattttactgagattttcagattcaccagttgtttatgttttgctccatttatttatgatttttcctcctctctcattcttctctttttttaattatttaagactaatatgtcaaatttgcccttctaccctgttagggttttgctgtgtccccacccaaatctcatcttgaattcccacatgtgtgggagggacccagtaagaggtaattgaatcatgggggcacgtccttcccatgctattctcatgatagcaaagaagtctcaaaagatctgatgattttatacaggggaatttccctgcacaagctctcttctcttgtctgccaccatgcgagacacggctttcaccttctgccgtgattgtgaggcttccctagccacatgaaactgtgagtctattaaacttcttttcttttgtaaattgcccagtcttgggtttatctttatcagcagcatgaaaacggactaatacatacccccaaatgaatcaatttgactttctaaaaaaaggacatctccctataaccaaagtataattatcaaaatcaaaaaagtttactcattgattttttaacgttaaaacatccttacatttctggaattaaaggaagtttgttagtctacattaaacttttaaaatattctactgaatttgtttaaaaagtatttacataagatttttacttcaatttgtatacgaagcctggattgtgtttttctttcatgtactgccctgtaagatttcttatcaagataatgtggccatcataaaatgtgttggaaagggtttctgcaattacagaaactaagtgttacagaactctaagtgttataaaagaattactattccattattaaatctttagaagaatttgcaggcaaatcctggcatggactattccaaaattgaatatgttaaatatttaatttcattaatgtaaatcagattactcatattttgtttttttcaagtgtctgctttagtaagtagtatttttcttagaatttgttcatttttttctaaattttcaaattgttgtcaaaatttgttcataatatccttaaataaatttaaaaaaaatcacgtgttgatgtataatttacattcattagaatttactcttcttagacatccagtttgatgattatggataaattatattcattagaatttacccttcttagatatacagtttgatgatttttgattaatgtatataatcatataactaccactgcaatcaatatacagaatactcccatcacccccataaattccctcaatttcctttgtattaagtctccaacccctacttatataccctggcaaccactaatctgatttgtctctatacttttgcctttaccagaatatcatataaatggaatgaaacagtgtattgcctttcatgtcttttgcaaaattatgttctttcatggattttaagtttcttctttttaaattgctaatattaacctactatctctatatagaaaactttgtttatcactagctgattgatgtacatttgagttgtttctaggtttaaggtattgtgaataatttgcatatagtgatttacatgaacttcccttgctcccttttttgggggtaaatttttaagagaggactttctgggttgtatgtaagagaatatttaaaatgataagaaacttccaaactgttttccaaagttgctgtatcattttgcatccccgctagcaaattgagagttttgtggtccacatcctcactatcacttgatactttcagttgtctataatttttaaattttagccaatttagttatatgtgtaggggcatctcattgtgaatttaatttacatttttctagtgaataataatgttggtcatttcttatgcttactggccatttgcatatcttctttggtgaagtgtttgctcaaatgtttccctactttaaaattttaaaaatttaaaattattttatattctgctaatattttacaactgaagttcacaaaacactgaaagggttaattcagacacactggcagaaactgcagtctctgataatctatatatattacttaccaataattggtacagagttgtgattaatgattaaaaagcctgagaaagaactaggacaaagcgcttctgagccttacgtaacttattttcttggactggatttgccaaaacaaaattgatctttggctgtatgtttttggtcgtatttcaaagaataatatctttaggagataattccaaatatccagaaaaatgcttatctcgaagtctacttctgaaactttaaacttgacccaacctcccacatgtcttttccaggcaattactttgactttctctaattcattctctagtcaggatcttaacctttatttttttttcttttccccagctttcttgaactaatagtatctatgaaacatattcttggaaagcaaagcaaacaaagaaacacacagttaaccaaaagttagcaatttgatgaacaatatcatgtcaaaagttagaataccatcccagtagtatgcctctgttgtttgtttgcagatctaatgaaatcataacatacgactctcagaaaacaataaggtaaagatggcttcttaaagatgtcctagacttaacagcaataaagttctaggtaggagactgggtccaattgttttttaacttttaatcccataagattttatctttattagaaggaatgatattttttaaacggtagttaaaaacaggtaagaaatgagagattattacacaacagtgcactctatagtatgtgataaacgtctctctctcttttgaactcaacagtctgaagtaaaatacaactatttcattaatcaatatgatatttaaatcaccaaattaaaaatgatcactgtgtgttaaaattgtctctaatgacacttcactatgcagaacatggtaattactttgaaaaatcagctattccaaggtaactgggcagttacaatattttatcaggtaaattacctgtcaccatcaacattcatcacagactcatttggattttattacagattgacatttacttatttgcccaacttttaaaattacaactgttgcacgattgccccagggtgcaactgtagaaaattagcacactaattacattaattatcataaataaaaggttatcaaagagtagcatgtaataacatagtattttttaaaagcaacttagggcatccctataataccttaaatttaggtattaaattgaaattttcaagactgctttacctctatagttttaatctttaacacctcagctacaggaatgttattgttaatgccatttcagaaatgaaaaagccgcagccaaaacagctgcatgatcgccctaagatcatacacagttgcaagagttaaaggtcaagtcaaaaaccacatttcctaaacttccaactttccattttttgcccctatatttttctgccttttagggatgaaaagtaaaatatttatcttttatgctccaatgtatcaacactttaagtgaactaaagatccaaaagtgagtctcatctgcttgctttttcccacctctattgctaccgacctagtcaagcaaacatcatctttcctctcaagtacctgtaacaactcccttccttcttgccccataaaaatccatattatacagagatacccaactgattttaaaatataaataagatcatgcccttttttttttttttttttttgcttaaaatgatctgtggattctcaacatactggaataaaatctaaatcaccaagtcctataaaattcatgtaatctgaacccctctcccatttcatctcctatcactctgtatcccctcattattctgctatttttgtctgattgttgagcctattgccaagattgagcctgcctctgagtctttgttcttcaattttactctgtttggaatgttctacccccaggtttctgcagaactggtttcaagttcctactccttaaagagattttcttaaataactgaacctaaactgacctttcttctttctccttctttcctacagcctatcctctagtcattccttatcacattctgttttatttttatgccatttttctttgctttcagaagttatcaactcctacaccttggaagtccacagaagagtttgtgtatcttgattactacctgtaacagaagctatgcattcttcactcctatctctaaaggctgctctggaaatcacctgcaacttcagttgatggttctcatatattctaaagagctttctatctcaaaatctctcagcctgaggctattctctgagtattattcctagcagacaagaaatgccaggaagttaagggctcaaagtattaggatggtgcaaaattaactgtgggttttgctattaatacaacctttattccatagataaaatcaggaaattactatgtacacggctccttcattcttcaggtggccaattataaaggtgtgttctacatctttcacagtctccagcatgactgaaccctagctgcccacagtagaaaccagcttattcctgtgcatttcattgcctttcatttctctatctattttgttgttaaataaaacaaaatcacacccacttccctgtccccagtgcctgactggcctcatcatacatactattgtcctcttctctgctctttgttttcaacattttccttccccactgccttgtcttgtctccactagtaatcttctttctataacttccttctctaagccatatgcttttatctctcaccaatgtcctggatcactgtcttgaaggtggttatctccacacggcatttttgtctccaagtttcgataactaatacttcccttcatcccttcaggcctagagaaggtaacagttgcagggtacatacagaattatcccttttggtttatctatacactatctacagcttttaaattgctcttttattatattttattcaaattaaacaacttaagtgtattgtgcattttccctagtacattcattggtaccatttgcacattcaggttttagtgtatattcaaagagtgattttcctttctttcttcctatgagatttttcacttctttcttgaaatttgcttaaagaatacagcatatccaggttttaggggaaaagagactcagcactaaaaacaataatactttgctatgcactaaattcacaagaacaatttttctttatctatttctgcttcttttttaattcctagagaaaccactttttgtctgatgtctcttctttcctcagaaaccttatttttgttatagctcaaagcaaacctctcgggcttcccttttggaggcaaacctctttagagtaggataaagacattgtactcttatttacttctcttcagttttattttattttatgaggaattaaatgtatagagtgaaatatacacatattaaaggtataaacccatgtgacacacatcttaatctgaacacaaaacaaataaacttctctcatgcccctttccagtcagtattgctgcaacataaggcaactggtgatttggtttctgtcaccataagttagttctgccagttcttgaacttcatataaatgaaaccatagcacatgtaatctttgggtctagcttctttcactcagtgtaaagtttttgaaatttttctgttgctgtgtgtcttgatagtttgttctcttttgttactgaacagtgttgagtaaaagagtcaaactctgtaaaatatttggagagatttattctgagtgaaatatgagtgaccatggcctgtgagacagccctcttcaggagaccctgagaaaatgttcccaaggtggttggggttcaggttgattttatacattttagagtgttaaaacacactaaatatggcctgagaaggactccatacttatatatttgaatctttgtggacaaattgcaacctaacttaataagtagacaagattgaaaaacctaacttaagagtatgcacctgtaacaatagctgagtgttggccaatcccagtagccatacttcaaccactcttacactactgagtgttcaaactgtgttcaactaaggcaaatgctaagctgtaaccaatttagttgtttctgtacctcacctccaatttctgtacctcatttccctttttatgtatataactctttcaccacgtggctgtgctgaaatctctctgaatctgctgtgatttcagggactgctctattcatgaattgttgattgctgaattgaacttctttaaatttaattcagctgaagtttttcttttaacagatggtgtcagaagtgggatctgaagtagagccttaacaatctccaggactgctgagtgaacaagcaaggtacctgcaaggacctacttttgtcccttgatctctcaaagtggctggggatcatgggtaagttctctcagatttcagaactccatggatttgtgtttggaattctctgagtttctctgaacaaatttgtgatccaagcagtttgaaagtcaggacagaaactgaactaggtccaggttcaggttaaatctggtaattagctgacttggatccagctggaggcctctctctctctctcttttttttttttttttttttgagatggagtcttgctgtgtcacacaagctggagtagaggggcatgatctaggctcactgcaacctctgcctcctgggttcaagaaattctcctgcctcagcctcccgaggagctgtgattacaggtgtccaccaccatacccagctaatttttgtatttttagttgagacgtggtttcaccacgttggccaggctcgtcttgaactcctgacctcaagtgatctacacacctgggcctccgaattgctgggattacagacgtgaaccaccatgccagtcccagttagaggccacttacctttggctgagacagaaagaaaatattagtaaatggtaatattgcagtggttgtaaaatttggcttttagaaatgcacagggattcttgcgttctaccccttcatttcatttttcttgtgtacataggtagaaaaaaattattggctaagtcaatcaacggaacctaagagtaaaaccaatatcttaggtaaaaatgggttccttaatttttgaaaatctgagtttcttccatctttttattttttattttatttatttattcattataattattattattttgagacagagtctctctctgtcacccaggctggagtgcagtcgcgcaatctcagctcactgcaagctctgcctcccgggctcaagcgattctcctgcctcagcatcccaagtagctgggattacagacgcgtgccaccacgaccagctaatgttttggatttttagtagagacgggttttcacagtgttagccacgatggtctcaatctcctgaccttgtgatccgcccgcctcggcctcccaaaatgctgggattataggtgtgagccactgcgtccggcctaaagaaacagaattttattaatttatcagctgagttagcattacagtggcttacgaagcatttgccattgtttgaggttgcagtgaggataacatgaaacacctgaagaaaaaccttcacaaaacctggtctctttccaacagcttagctatgtgagaatagcttttataacatgacaaccctaaaaataaaaccattttaaacttaaagctgtccttccagttgctgtttcaaactttatcccaagaactgaagtgtcattcagtaaaaggcaactacaggcttctcagcagtaaggctaagtacttgttttatgttttctggtgatgaatttatttcttgtctttaagtttacagtgacagctataaaagtgattgtcaatagtattagtataatttaattactaatagaatgtgttttccatgtatgttttagtcagagctatgattttcttaataataccagaacttattttgtgctctatgatgatgacattagtgatctgtattctcagcagtattttacagtgcttcagactattaatacactaatctgtgtttttggctgggtgttgtggctcaagcctgtaatcccagcactttcacaggctgagacgggtggatcactcaagctcagaagttcgagacaagtctgagcaacattgtgaaaccccctctttactaaaaatacaaaaattagttgggcctggtggtgggcacctgaaatcccatctatttgggacgctgagacagtagaatcatttgaacccaggaggtggaggttgcagtgagctgagatcgcaccattgcactgcagcctgggcaaaaagacggaaactccatctcaaaggaaaaaaaaaagagtaaatagtaaaatcgggtatggtggctcatgcctgtaatcctagcactttgggaggctgaggcgggtggatcacctgaggtcgggagttcgagaccagcctgaccaacatggagaaaacccgtctctactaaaagtacaaaattagtcaggctaggtggtgcatgcctgtaatcccagctactggggaggatgaggtagaagaatcacttgaacccgggaggtggaggttgcggtgagccatgatcacaccattgcactccagcctggacaacaagagtgaaactacatctcaaaataaaataaataaaataaagagtaaatagtattcctttatgtgtgtgcatgtctgtgtgtgtatgtgtatatatatcacattttctttatccattcatctaatgctggcctcctaggttgctttcatatcttagctattatggatactgctgcagtgaatatggtagtgcagttatctcttcagtatgctgatttcaattcctttagctatacacccacaggtgggattgctggaacatacagtaattctatttttaatttctgatgaatctccatgttattttccttaatggctctattcatttatgttgggaaatataattacttttttttttgagacggagtctttctctcccaggctggagtgcagtggtgtgatctaggctcactgcaagctccacctcctgggttcacaccattctcctgcctcagcgtcctgagtagctgggactacaggtgcccgccacctacctggctaatgttttttgtattttcagtagaatgatgttgggaatggactggtttattcaataaatcgtgttaggtacattgactaatagtgtgtaggattgaagttatatttactgaattctttaaggtatagtcaaaacagactgaataattaaatgtaaaaatgatctggagaaaaccttcttgttttgtttttttgagatggagtctcactctgtcatccaggctggagtgtagtggggtgattttgactgactgcaacctcagtttcccaggttcaagtgatactcctgcctcagcctcccaagtagctgggattgcagacatgtgctgccacactagaataattgtatatgttttaaaataggaatagattttctaagctaaactgaagataaatgctaaggaaatagtgagatttcacttgataattatgtgtctgaatgaatcagccaattaataaaatgaaaacaggtcaagggtagtggtgcctgcctgtaatatgaccaccttgggaggctgaggcgggtggatcacttgatgtcaggagttcaagaccaacctgacaaacatggtgaaactccatctctactaaatacaaaaaagtagcctgttgtggtggcacatacctctaatcccagctacttgggaggctgaggcaggagaatcacttgaacctgggaggtggaggttgcaatgagcagagattgagccattgcactccagcctgggcaacaggagcaaaactctgtctcaaaaaaaaaaaaaaaaaaaatcactgcctcaccaactttttcacatagaatgattaaggattccagagcccatgctacctctaggggctcctgcccctcccacatcacacatctatcttgacacggctagttacagagaagaaaaggcccagtaaattaatatcacaatcattgccacatacccaccaaaatactcaaattaaaattttgacaaaattaagtaccaacaagaatgcaaagatttgggaattatcagatattgtaagactgtcagttggtgtgctaacattgggatgaaaccaataatagctagtaaaatggaagatatgtttgccctgtaacctatggtttcacctcttgttttatactgttcactatacacactatacacactaatggtaaccaaatagaaatacacaaatgttcacaacagcatcatttgtaactgacaaaaatgaacacaacccacatgtccaccaacaatgaagggatacacactggtgtactgtatttttatttttatttttatttttatttttatttttatttttgagatggggtcttgctcagtcccccaggttggagtgcagggcgcgatctcggctcactgcaatctctgcctcccaggttcaagcaattctcctgcctcagcctcccaagtagctggtcttactgatgggtgccgccactcccagcaaatttttgtattattggtagagacagggtttcaccttgttggtaaagctggtctcaaactcctgacctgaggtaatccacctgtctcagcctcccaaagtgctgggattacaggtgggagccaccatgcctggctttttttttttttttttttttttttttgagactgagtctcactctgttgtccaggttggagtacagggtgcagtcttggctcactgcaacctccaccacctcccaagttcagctgattctgctgcctcagcctcccgagtagctgggaatacaggcacgtgtcaccacgtccagctaattttttgtatttttagtagagatttggtttcaccaagttcgccaggatggtctcgatctcctgacctcatgatccactggcctcagcctctcaaagtgctgagatgacaggcattagccaccgcatggcctaatttttgtagttttagtagagatggggttacaccatgtaggctagggtggtctggaactcctgaactcaaatgatctgtctgcctcggcctcccaaaatgctgggattatagacgtgagccaccgtgcctggctgtgtactgttttaatagaatgcagaaataatgctaaatgtgaatattaaatacttaatattgagtaaaagaagccagatgcagcagaatacagacttttactccaattatgtaagagaaaaaccaggcaaaaccagactttactttaggcttttaaaaaatgcataataaggccaggcactgaggtcaggagtttgagaccagcctgaccaacatgtgaaaccccgtctctactaaaaatacaaaaattagactggcatggtgacacatagcccatgcctgtaatcccagctatttgcgaggttgaggtatgagaatcacttgaatccgggagttggagtttgcaatgagtcaaaatcaggccactactctccagcctgggtgacagagcaaggctccatctctaaaaaaaaagaaaaagaaaaggaagaataaatacataataaaattataaagagaaccaaggagagaaacgcagatatccacaggtaatgtgggtatctgttatatctgttactaataagggaaggaagactttaggatgagttaggggcatacagaggacttcttggtggtgatagtgctctatttcttcacctggataggtatcacacagacgtttatttaataactgatgtatccatatgtttgtttgcatatttcacaataagaatgaaatggaggaaaggaacgtgaatggaaagagatttctccattcatcaaaattttaaagtcatatttttcctcaggttcttctccaggttcagtctgaaatggtgaaagcagccaagtgtggtggctcacgcctataatctcagcacttttggaggtaacagagtaagactctgcctaaaaaaaaaaaaagagaacaacagagtggttatcaggtagagaggaagggaggaaataaggacatgtgggtcagagatacacagtagcagatatgtaggatgaacaatcctatacatctatatacaacatgaggactataggtaataaaattgtactgtatatgggattcctgctaaataagattttaccttcccttgccacaccaaaaactgtgggtatctgtgatagatatggtaatttgcttcactatagtaacctttttactatgtatatgtattctataacatcatatgtgtaccttaaatatacacaataaaatttattttaaagagaaaaaattggccaggtgtgatagttcacgatggtaatcccaaaactttgggaggccgaggcgggcggatcacaaagtcaggagtctgagaccagcctggccaacatggtgaaaccccgtctccactaaaaacacacacaaaaaattagccgggtgtggtggcacacacctgtaatcttagctactcaggcagttgaattgcttgagcataggaggcagatgttgcagtgagatgagatctcaccattgcactccagcctgggtgacaggctgagactccacctcaaaaaaaaaaaaaaaaaaaaaaaaaaaaaaaaatatatatatatatatatatatatagagagagagagagagagagagagagagaaattatgaaagtatgcacaactaaattaaaatgtcaactctaaagtgagctactgagtgactggggtgcatgagagaaaaggttacttaacatttttatacctattgaattgtatcctatgtatgcattataaatttaaatgtgcaataatgcagataactgacatgtgggtatgctttgattaggactttgcatttcccttttgctcaaattccttatgattctagatgcgtatgaatagaaatacaaaatgtaaggagacatgggacttctgatagccctttcttctttccatgttttgtgtctctggttgtagtttgccatatgagtccatatggctaatgagcaaaatatttttcagatggatacatgtgaccaagcattgcaagttaaagatatttctgaatcttggacctcttatttacagtgaagccccctcatgcatagtaaagcagagaggaatgtaaaaggttgctgcatcgataatcaatttctggtgagcaataattataggtaatgtaaaatgggacaattattgcttttcatcatatcttgaaagaactcttacagtccatgattttgaaaaaaaaaatctaagttcactctttttttttctattaaaaaaagacattatcctgtagaagttcaagagtaaaatctgaaggcagcttatctgacctggccacatggtcttgccacttgttaaatataactttctacacactaacttctccagacctcagatcttcaactctctaaaatggaaacctagtagtatttgtctctagacctgcagctgaactgagcattttagggaaggaacaaacatacacacgatatatatatagtcagattatgaacccagtgtagcccagaatgcaaaaatttctcagtaacagagatccccaagagaaaaatgtgatttagtttatctcagtggcctttcatgtggcaaatgaaaagttaaagtccataatgagaaatatatgggcagccagtgacaccatccattcaatgtagactctcaacatctccgacagtcattccctgttgtaccccaacctgcttatatattggggtgatatcaccttttgatcataacgtacataaacctcaagcctcagtaataaatatttatggacaatcagatattctgtgtttccagtcaaaactcaggtagatcacattttatgtgacaggagaaggaacagttgatgcccagttaaccctgagatcatctctgtctgcatcttcctatcatcatagcaagctctttctctgcagtccaccgtctgtatctgccctttgctatatagatagcaaaaataagcatctgaaaagttgctcaacaccatatgtcaccagggaattcaaattaaatcaatgatgagataccactacacatctattagactggctcaaatccaaacgctgacaccaacaaatgctgatgaggatatggagcaacaggaactctcattgattgctgctgggaatgtaaaatggtaaagccactgtggaaggcagttttgcaaattcctgcaaaactaaacatatgcttaccatatgatctggcaattgcattctttggtatatactcaaatgacttgaaaacttatacccactcaaattctgcacatgaatgtttatagcagcttatacatgaccaacaaagattggaagtaaccaagatatcctacaatagggaaatggataaactaactgtgaagcattcatacaatggaatattcttcaggaataaaaagaaatgaactaccaaggcatgacaagacatggaggaatcttaaacacgtatttctaagtgaaagaagccaatgaaaaaaggccacatagtgtagagttccaattatatggaatactagaaaaggcaaaactaggcagatggtattataaaaagttcagtggttgccaggggcttgagcagagggaaggatgaataggtggaacacagaagatttttagggcagtgaaacttttctgtgtgaccctatagtggtggatatatgtgcttaagcatttgttgaagcccataaatggtagaacacaaagagtgaatcttaatgtaagccatgaacttaataatatcaatattggctcatcaagcataacaaatgtaccacactaacaagatgataatagaagaagtgtgtgtactgtggtgtgaggcagatattaagctcaatatgccttctgctctatttttctgtacacctacaactgttctaaaaattttcaattatttatttgttaattattattttctaatatatttttcgagatggagtctcactctgttgcccaagctggaatgcaacagcatgatcttggcttactgcaacctctgactcccagcttcaagcgattctgctgcctcagtctcctgagtagctggaattacaggcacccgctaccatgcccagctgactttttgtatttttagtagagatggggtttcaccatgttagccaggatggtcttaatctgctgacctcatgatccacccaccttgccctctcaaagtgcttggattactggtatgagccatcgcaccaggtcttatttatctttttgagacaggttttagctctgtcactcaggctggagtgcagtggtgcaatcgtggctcaatgcagccccagcctccagggctcaagtagccatcccacctcagcttactgagtagctgggaccacaagcgtgtgccaccatacctggcacatttcttagacctctgaaaagatgctcaacaccatatgtcactaggaatatttagtattcaactagaggcttcaatgggctctgaaatatcccctcctgaactctataaaaagcatgtttccaacaagctgaatgaaaacaaaggtttacatctgtaagatgaattcacacatcagaaagcattttcaccaagaacttttctagttttatagcaggatgttcattgtttcaatattggtctcaatgggctccaaaatgtccctttgtacagtctacaaaaatttttgccaatgtactgaatcaaaacaaatgtttaacactgtgagatgaattttcacatcaccaaacatttttacagataatttgtatctagtttttaatcacaaaactttgaatttttcactataagcctcaaagggctctaaattgtcccctcttagcttctactaaaagagagttttgaacctactgtgtagaaacaaaagtttaactatgtgaaataaatccccacattgcaaagctatttctcagatagcttgcttctagtttttatcacgaattattcagcttttcactgtaggcctcaatgggctccgaaatgtcccttcatacattctacaaaaagagtgtttccaacttagctgaatcaaaagaaattttaaactgtatgagatgaaaccgcaaattgcaaagcattttcacatatagcttctatagtttctatcgtataatattcagtttttcactacaggcctccatgggctatgaaatgtcccctcataggttctataaaaaggtgtttccaacatgctgaatgaaaacaaagatttaactttgtgagatgaacccacacatcacaaaccatttttatagatagattttctctagtttttattgtggaatattcaatttcatgctacaggcctcaatttgctccaaaacttccccttgtagattctacaaaaagaatatttccaacctgctgaatcaaaagaaatgttcaattctgtgagatgatatgcaaagctttttcacagacagcctgtttctagtttttatcctggggtatttgatttttcactgtaagcatcaatgggctctgaaatgtccctttgtagattctacaaaaagagtgtttccaacctgttgaatcaaaacaaagttttaactttgtgagatgaacccacacatcacaaagcattttcacccacagcttgtttctaatttttaccatgggttatttgtttttcactaaatgcctcaatggactatgaattgttgccttgtagattgaacaaccaaagagtttccaacctgctgaaggaaaacacaggtttaactttgtaagatgaatctacccattgcaaagcatttttacagataggttgctttgagtttttatcaagagatatttgatttttcactgtatgcttcaatgggttatgaaactccccttgtagattctacaaaaaaagtttccaaactgatgaatcaaaagaaaagttcaacttttgagatgaaatcacacaacacaaagtattttaagaaatagcttctttatagtatttatcgcaggctattagattttccaatattagcctcaacaagctctgaaatgtccctttgtagattgcacaaaatgagtgtttccaacctatggaataaaaaggaaggtttaactctgtgagataaatccaggcatcacaaagcatattcacagatggcttatttctaatttttgttgtgggatatttggtttttcaataaaggcctcaagcactccgaaatgtccctttgtagattatataacaagagtgttttatggctgcatagtattccatggtgtatatgtgccacattttcttaatccagtctatcactgttggatatttgggttggttccatgtctttgctattgtgaatagtgccgcaataaatatacgtgtgcatgtgtctttatagcagcatgatttatagtcctttgggtatatacccagttcatgtcctttgtagggacatggatgaaattggaaatcatcattctcggtaaactatcacaagaacaaaaaaccaaacaccgcatattctcattcataggtaggaattgaacaatgagaacacatggacacaggaaggggaacatcacactctggggagtgttgtggggtggggggagtggggagagatagcattgggagatatacctaatgctagatgacgagttagtgtgtgcagcgcaccagcatgtcacatgtatacatatgtaactaaactgcacattgtgcacatgtaccctaaaacttaaagtataataataataaaaaaagagtgttttaaaagtgctgaatcaaagcaaatgtgtaactctttgagaggaatccacacatcacaaagcatattttcagatcacttgtttctagtttttaaagcatgatattcggtttttcactatatgcctcatcaggctcagaaatgtctcatagtagattttacaaaaatagtgtttcctacctgctgaatcaaaacaaccgtttaaatctgtgagatgacgccaaacctcgcaaagcattctcacagacagttttttcctagtttttatcgcaggatattcggtttttcagtataggcctcaatgaactttgaaatgtccattcataggttctataaaagtgtgttcccaactccctgtataaaagcaaaggtttaactctgtgaaatgaatctacacattggaaagcacaaaaatagcttgtttctagcttttatgatgagacatttgattttttactattggcctcaatgggctcagaaacgtctctttgcagattctacaaaaaaagttttttcatttttctgaacaaaaataaaggtttaactctttgatatgaaatcacacatcacaaagaattttcacaaatagcttttttctagggttcatcactggatattgggtttttcactataggcttcaatgcagtcttaattgtaacttcttaattctacaaaaagagtgtcccccaacctgctgtatgtaaataaaggtttatctctgtgagataaatcttcacattgcaaagcattttccccaatagcttgtttctagtttctatctcgggatattgatttttcactataggcttcaataggctttgaaagattcctgtgtagattccacaaaaagagtgttgtgacctgctgaatcaaaacaatgtttaactttttgagataaatccgcacatcacaaagtattttcacagatagtttttttttttttttttttttcagatggagtctcactcagtcgcccaggctggagtgcagtggtgtgatctcggcttcccaggttcacaccattctcctgcctcagcctcccaagtagctgggactacaggtgcccgccaccacgcctggctaattttttgtgtttttaatagagacagggtttcaccgtgttagccaggatggtctcgatctcctgactttgtgatccacctgtctcagcctcccaaagtcctgagattacaggcatgagccaccgcgcctggccaatagctttgtttacttttattgtgggatattggtttttcactacaggctgatattggcttcaaattgtaccctcatagattctacaaacagtgagttttcaagcatctgaagcaaaataaaggtttaactttgtaagatgaatcctgcacattattgctggatattcggtttttcactgtaggcatcaatttgctctgaaatatcctattgaagattttaccaaaagagtatttccatcctgctgaatcaaaagaatggtttaattctgtgagatgaaatcacccatcgtaaatcattttcagagacagcttcatatagtttttatctcagaatattcggtttttcactataagcctcaatgggctttgaaatacatcctcatagattgtacaaaaaaaaaaaaggagtttccaaacagttgaatcaaaacaaatatttaatgttgtgagataaattcaaatatcgcaaagcattttcacagttttttttttctagtttttatcatggaatattcggcttttcactgtagtcttcagtgggctcagaaatgccctttgtagattccacaaaaagaatgtttctaacctgctgaaccaaaacaaaactaactctttgaggtgaatccacacattgcaagcattttcacagatagcttgtttctagttttgatcacggaatattagatattttacaatagacctcaatgggctcagaattgtccccgcttagattctactaaaagagtgtttccaaaatgctgtataaaaataaaggcttaacactatgagatgaatcaacacatcacaaagcattttcacaagtagcttgtttttactttttgtcgtgagatattcagtttttcaatatattcctctatcggctctgaaatgtcccttcatagattctatgaaaagagtgtatccaactgactgaatcaagacaaaggtataactctgtgtgagaaatctacacatcacaaagcattttcactgatagcttgtttctagtttttatcatgggataattggtttttgactataggcctcaatgggcttcaaagtgtccctttgtagattctacaaagagtgcttcaatcccgctcaatcaaagcaaagatttaattctctgaaatgaatctacacatcacaaatcattttccagtatagcttgtttctattttttattgtgggatatttgatgttttactttagacctcaatgggctctgaaatgtgccttcttagattctacaaagagtgtttctcacctgctaaatcaaaacaatggtttaactttgtgagataagtccacacattgcaaagaatttttactaatagcttatttctaatttttatcatgggatattcaattttttcagtgtagtcctcaatggtctctgaaatgtcccctcgtagattctacaaatagagtgttgcaacctgataaatcaaacctttaattctgtgagataaatctataaatctacacatctcaaagcattttcacagatagctggtttctggtttttatcacgggatatttgatttttcactatagacctcaataggctctgaaatgtcccctcatagagtctacaaaaagagtgttttcaacctgctgaataaaaacaaaggtttaactctgtgacataaaataacaaatcataaaacattttcacagttggcttgtttctagtttttatcacgcgatactcagtttttcatggcagggcacaatgggctccaaaatgtccctttgtacattctacaaaaagagtgattttggcctgctgaataaaaacaaaggttttatactgtgagaggaatccacacataggaaggaattttcacagatagcttgtgtctagttttcattgcaggatgttcagttttttcatatacttcttgatgggctctgaaatgtctcttcatagaccctacaaagagagcatttacaacctgctgaataaaaacaaaggtttaaccctgtgagttgaatccacacatcacaaagcattctcatatatagcttgtttctagtttttatcttgagatataacgtttttaactttaggcattaatgttctctaaaatgtgtcattttagtttctacaaaaacagtgtttcaacctgctgaattaaaacaaggtttaactctgtgatatgaattgacacatcacaaaatattttcacagatagctttttactagtttttgtcatgggattttcagtttttcactaatgtctttcatgtactctgaaatgtccctatgtagattttacaaaaagagtgtttccgacctactgaatcaaaacaagtgtttaaatctgtgagatatatccatacattgcaaagcactttcacagattgctagtttctagcttttatcatgagatacttggtttttcactatagacctcaataggctcccaaatgactctcacagattgtacaaaaagagggttttcaaagtgctgaatcaaaataaagatttaactcagtgaggtgaatccacacatagcaaaatattttcacagatagcttggttttgtttgtttgttttgtttttattgtgggatatttcatttttcactataggcctcaatgggcaccaaaatgtcttctcctagattctacaaactgactgtttccaacttgcttaatcaaaacaaaggtttaactctgtgatatgaatatacacatcccaaaggattttcacagatagcttatttctagtttatatcttctcgtattttgtttttcactgtaggtttcaatgagttttgaaatgtttcttcgtagattgtgcaaaaagagattttaaagctgccaaattaaaacagatgtttaactctttgagatgaatccacacactgcaaagcattttcacagatagcttgtttctagtttttatcatgggatatttggtctttcactgtagtagtcctcaatggactctgaaatggcccttagtagattctacaaaaagagtgtttccaacctgctgaatcaaaacaaatgtttaactctgtgaaaggaatccacacaacgcaaagcattttcacagatagcttgtttgtagtttttattgcaggatattcagtgttttaatgtacttgtccatgggctccgaaatgtcccttcatatattctacaacaatagtgttttctacatgctgaaaaaataacatatgtttaactctgagagatgattccccaaatcacaagaccttttcacagatagcttgtttctagttttcattgtgggatatttaacttttcactataggtctcaatgagctttgtaatgtccttttgtacaatctgcaaaaagagggtttccagcctgctgaatcaaaacaaaggtttaactctgtgagatagatccacacattgcaaaacattttcacagatatcttctttctacttttcattgtaggatgctcactttttccaaatacttctccaggggttccatattgtcccttcgttgattccacaaaaagagtgtttccaaccagctaaatcaaaacaaaggtttaactctgtgagttaaatctacatattgcaaagcattttcacagatagcctgtttctcatttttatcacaggatcttcagtttttcaccataggcctcaatgggcactaaaatgtcttctcatagattctaaaaacagactgctttcaacctgcttaatcaaaagaaagctttaactccatgatatgaatccacacattggaagcattttcacagatagcttgtttgtagtttttttctccacatattttgttttttactataggcttcaatgggctttgaaatatttctttgtagattctgcaaaaagagtgtttccaaactgcatatttaaaacactggtttaactctgtggcatgaatccacaatggcaaggcattttcacagatagcttttttcttgttttttttaggggggagggtgggggaagatatttggtctttcactgcaggtctcaatgggctctgaaatggctcttcatagattctacataaagagtgttcccaacctgctgaatcaaaacaaatatttaactctggaagatgaatccacacatcacaaagcattttcagttatagacttttattgtttttattgtgaaatattctgctttttaatataggcctcaatgggtgtgaaatatcccttcatgtattctataaaatagagttttcaacctgctgaataaatgcaaaggtttaaatctgtgaggtgcacccacacattgcaaagtgttttcaaagacagcttgtttctacttttatcatgagatattttgtatttcactatgggcctcaatgggcttcaaactgtccctctgtagactctacacaaagagtgtttccaatctgcttaatcaaaaaatgattaactctgtgagatgaatccacacatcacaaagaacttttactgataacttgtttctggatgttatcatgggataatcattttttcattaacctgctgaatgacaagaaagatttaactctgtgagatgaaatcacacatcgcatataactttcagacacagcttttttgtagtttttatcacaggacattaagtttttctctacaggcttcaatggactttgaaatgtccttgtgtagattgtacaaggagagtgtatccaacctgctgaatggaaacaatgtttaattctttgagatgaatccacacatcccaaagcgtttttacagataggttgtttccattttttatcatgagatattagggttttcactataggtttcaatgggctctgaaatgtttctttgtacattctagaaaaggagtgtttcaattctgattgaactgagtgttctgattctgccgaatcagaagaaagttttaactctgtgagttggatccacactttgcaaatctttttcacagatagcttgcttctagtttctttcatgggatatttggtctttcactataggcctcaatgggctctgaaatgtttttaagtagaatctacaaaaacagtgtttccaaactgctgaattaaaacaaagttttaaatatgtgacattatttcacatatcacaaagcattttcacagataacttgtttgtagtttttatcacgggatattctgtttctcactataggcctcaggggttcaaaatgtctttccttagatttacaaaaaacgtgtttctagcctgctgaatgataacaaatatttaactctgtgagatgaatccagacactgccagtcgttctcacagatagctgttttctagttttgtgtgtgagggatattcgcttttttacaatatgcctcaaaggtctcagaaattcccattcgtagattcaacaaaaagagtgtttccaaattgctgaattaaaacagtggtttaactatgtgagatgaatccaaacattgcaaagcatttggacagatatcttctttctagtttttatcacaggataattgatttttcattatgggcctcaaaggtctttgaaaatgctcttcatagattctacaataaaagtgttttcaacctgttgaatcaaagatttaactctaggagatgaatcaacacatcacaaaccatattcactgataccttatttctagtttctatcatgggatattcagtttttcactgtatgcctcaaagggctccgaaatgtccctccaaagattctacaaaaagagtgtttccaaaatgctaaataaaaaaagtttaactctgtgagaagaatccacacatcacaaaacattttcactgatagcttgtttttagttttcatcgtgtaatatttgatttttgtgtttgtttgtttgttttactataggccccaatgagctctgacattttttctttttagattcaacaaaaagagtgtttccaacctatggaatcaaaagaaaggtttaaatttgtaagatgaatcgacacatcacaaagcatgttcacagatagcaaacttctagtttttttccgcaggatattgtttttcactgtaggcctcaatgggctttgaaaagtttattggtagatactacaaaaagactgttttcaacctgatgaatcaacagaaaggtataactctttgagatgagcccacacatcctaaagcattttcgcacatagcttactcctagtttttatcatgagatattctgtttttcactatagacctccatgcgctccgaaatgtccctttgtagattctacagaaagagtgtttccaaattgttgaattaaaacaaaggtttaactgtgtgacattatttcacagatcacaaagcattttcacagatagcttgtttctagtttttatcgcaggatatttggttttaaactccaggcctcaatgtgcttcaaaatgtctcatcttagattctacaaaaaaacatgtttccaacatgctgaatcaaaacaaaaagttggctctgtgagataattccatgcctcgcaaagccttttgacagatagcttgcattaagttttcatcacgggatattccatttttctctataggcatcagtgggctccaaaatgtccctttgcagatcctacagtgaaagtgtttctaaactgctgaattaaaacaaagatttagctttgtgagataaatccagacatcacaaagcatttcactgatagtttgtttccagtttttatcacaggatagtcagtttcttactataggcctcaatttgctctgtaatatcccctcttagattccagaaaaggagagtttccagcctactgaatcacaagaaatgtttaactctgtgagataaaatcacacattggaaagcattttcagacatagtttctttgtagtttttaatcgtgggatatttggtgtttccactataggcctcaatggattttgaaattttccctcatagggacacaaaaaaagtgtctttatccttctgaatcaaaacaaagttttaactgtgaaaagaaaatccacacatagcaaagcattttcaccatatctgccaacaaggaaactcttgttctcccactcttatcagagggctgcatgattcctataggatgagaagcaggcagcggtgtcaggatttgcctggtcatctaggctctgttacagtcatctacatgttctttttcactgtggaggggatcttttattgatctgttgctacgggggactgcctctctctacagatcttttggctgccagggatttcagggagtaaaaagtacttcgggtaggctggctgcactccaggttgtgagtagtggtctcactgtgggggattggggtgtttgcaggaggcttttgggtcctctggcaggaatccttgaacatggcttggacgctagcacaggccctctcattctccaaggcaagaattgattttccattgctttcatgaggagtccatactactcttcatcagcgctcctaaacacactttttttggcttgcaattgcctcagacggcgactgagacactctctgaactgcatctgcactcgtgaggtctgttcaaagtgtgagacttctgcttcaccttcaacttgcctttgtcatagttcctgcctttcccagagagccatgttgagtagtaggagcccctgtgaggcccaggatgaagggaggcagtgagctcaagggccctgccattttctgctgacatctgcctctggggtttttggtatgatttcatcacctggacaccccttaacatctcagcagactgtattcccttcccccatgggacccaattcttgcacacagcctctttggggaatggaatcagaggaacagtttccagcgccccacatcacagtctccaagtgcctccttctccagcgggacctgaccatgaagatggcccgaatgggcctgcctggagggtgtgggggtgagtctttttgaaatgtgcccctctccgtgatatctaggtacagtctgcctgtgttccccaggctgctctctccaaagaggagcttcctgcagaaacacacagcctctgaagctgctgggatgtgtgtttctgtgggagtgtttcaagttgtggatatgtgtgtggctgcggtcatgtgagtgtgtgtgtgtgtgtgtgtctgtgtgtggaggtaagtggagtctgctgaaagaaatgtggctaacacactgcagcactgtttttgtcaccccatcttccggtggcctgtctctgtggttctgcttgggctgaagttctccatgttcttcatttttccatggctcctgaatccacagtgaattggaagaatggctgacaactgccaggttcaaaatcacctccccttgccaaaaagccacatttctacaaagaagagaagcacaccacaccccaaaacagacaactccccatgctttattgttctgtggccaacccagggccagaccccagcagtccagtcacagggcttcttgaatttacctcgatttttgtttgtagctgagcaggtgcttcaggtcatcagggaggcactcctccattgtctcagaattttattgtgggacacagagtgtgagcaacaataaggtcagataggggtgaggatacagtctgttgaggtgtggatgagatctcgcaccttcacctgcaaaaaaggttcagacagatgacacagaagttgcttccaactgcatcccctcattccgttcattgcacagtcaacagcatggcctggtgcccaggtgggatgactcaatcgtgcagggaaaagttggattgcaaaatggggcccttctggccagctccagaattgagcttccattcccagagccacattggagtgagatggactgatgctgggttggatgtggcctccacactggcaacctattttcctgacttccatgttccttatgggcctagagtttcctaggtctggctcagtctgacttccatgttcctcatgaacctggggtttttctgggtctggctcaaagtcttccacactaaaagtttcccagttcatggaggataattctcatgggaatccatcgcatgagtgttttcttataaacactgtcacattttaattactgggcagttgtgatacttttggaatcataaatttcgattatatccaccatcaagataacttgttctcccacttctaaaggacagctgcatgactcctgtaggatgagaaacaggcagctgtgtctggcttttacctggcaatctaggctctgtttcatgtcatctgcacttcctttctcattgtggatggggtatttcattgggctgttggtgggtgggactgactcattgtggatattttggttgccaggtatatcagaaagcaaaaggtattttgggtaggctggccacacaccaagttgtgggtagtggtctcataatggtggctggcattgtttacactttgcaggaggcttttaagttctctggcaggaaaccttgaacatggcttggactcctgcacaagtctgctcattctcccaggagaaccttgacttttctttgctttcatggggggtccacagtgcccatcaacagcactcctggatgttattttcaggtttcaaaatgccccagacatcctctgagacactctcttaacctcatgtgcacctgcaagaggcctgttttaggtgtgagaacagtgctccaccttggacttgcctttgtcatggttcctgcctttaccagagagccatgctgagaagcaggagcccctgtgaggcccgggatgaagaaaggcagggggttcaagggcctggccatcttccactgacacctgcctcttggatctcagatattattccatcacccagagacctcttaacaactcaccagactttattcccatccccaggagaccgaattcatgcacacagcctcttttgggaatggagtcagaagagcagtctccagagcccacctcacagtcttcaaactcctccttctcctgtgggaccctaccacggagatggctcatgaaggccctatgttggagactattagcatgcagcagttggttgctgcaggcagcctttttctggaaactaggccagctctggctgtaccattttcctgagctttgccaggcttacagccctgacagccaggtgcctgagcctgctttgtgaatgcgcatgtgacagtcaggccaccaggcaccagtggtgagcagcggctcacatcacagtgaatgccaccattgcctagtgataagtcccttcatcttggtggagaaggagtcctctgtggctgtgtgtcggcattgaactatcacctgtctactttgagggctctatgggatattcccacaatcctaggagtgggcagtggcgagccagcctgaagacacatcaagtggagccccaggaataaaccacaaaatccctaaggatccaaaaggatacccacgatgggtcaggcctgcctaggcggtgtgggagtgagtctttttgaaacttccctccctgtgatttctaagtacagcccgcctctgttttccagggctgctctctctcagaaggggctttctgcagaaccgtgcagcctcaggagctgtcagtctgtgtgtttctgtgggagtgttgtgagtgtttgaatgtctgcatgtgtgtgtgtggctgtatgtgtgtttgtgtgtgtctgtgtgtggggggggggacatctgctaaaaggaatatgtttaatgcactgcagcgcttttttttttttgagtcccttcaccttctggtgcacctgtctgtgtggctctgcttggcctatggggctgcatgttctttgtttttctgtgcttcctgagtccacggtgagttgggggggatggttgagactcacaggtgtacaaatcacctcctcataaaaaggagccactcttctagaaagaagaggagcacaccactctcaggagaagacacctgtccgggcctcattgtcctgtggccaacccaggacaggaccctagcagtcctgtccacaggccgcttaaatccaattcgaatttggtttgcagccaagcaggtgcttcacgtcatgaaaggagcactcctccaacatcttgggatttcattccagaactaggattgtgagcagcaataaggtcagatacgggtgagcatacagtctgctgaggtgtggatggggtcctgcaccttcatctgcaaaaaaaggtgcagccagatgacacaggaagtgcttccaactccatccttgcattcccttcattgcacaagctgtccacaacatggccctgtggtcaggtgggaggactccaacttgcagggaataaaaaaaaaggtttaactgatacaaaaaggtttatctctgtaagatgaatccacacatcgcaaatcatttgcaaagatagcttctttttagtttttatgccgggatattaggtttttcagtatagtccacaataggctctgaaatgtcccttcatagattctacaaaaaaggtgttttcatcctgttgaatcaaaacaaaggtttaactctgtgagataaatccacacttcacaaagcattttcacagatagacagtttttagtttttactgtgaaatatttcgtgttttactttagtcctcaatgttcacaaaaatatctttttttttgtatatgctatataaagagtgttctcaacctaccgaatgataataaaggttaaactttgtgagatgaatccgcacatcacaaagcactttcactaatagattgttgctagtatgtatcgtggcatattcactttttcaatatacttgtcaatgggttccaaaatgttcctttgtagattctttaaaaagagtgtttccagtgtgctgaatcaatataaaggtttacctctgtgagatgaatccacacaccaccaaccattttcaaatattgcttgtttctagtttttattttgaaatattcattttttcactataggcctcagtgagctccaaaatgtcccttcataggttgtacaaaaagagtgttgccaacctgctgaatcaaaacaaaggtttaagtttgtgaaacaaatccatatatcagaaagcattttcacagatagcttgcttctagttttaatcactggtattaggtttttcagtataaccttcaatgtactttgaaacgtccctttgtagattctattaaaagaatgttttcaacctgctgaataaaaacaaaggtttaactctgtaagatgaacccacacatggcaaagcatttacacagatagcttgtttctagattttattgcagaatattcaattttccacagtaggcctcaatgggttctgaaatatccctttatagattctacaaagagtttttccaacctgctgaatcaaaaaaagttttatctctgatagatgaattcccacatcataaaacattttcacagatattttgtttctagattttatcacaggatattagatttttctctataggcctcaatgggctcagaaatgttccttcccagattctacaaaaagagtgtttccaacctgctgaatcaaaataaaggtttatctctgtcagacgaatgaacacatcacaaagcattttcagagataacttctttcaagtttttatgataagatatttggttttccactgcaggcctcaattggcttcaaaatattcctctgaatgttcttcaaaaagattgttttcgacttgctgtaataaaacaaaggtttaactttgtgacagatagcttgtttcctgtttttatagcagaatatttggttttacaactataggcctctatgggctgtgaaatgtcacttcatagattctaaaaaagagtttttccaacctgctgaatcaaaacaattttaactctcagttgaatccacacaacacaaaggattttcactgatagatttttctagtttttatcaaggaatatttgttttttattgtagttctcaatgggccttgaaatgtcttttaacacattccagaattagactgtctgcaacctgcagaataaaaacaaaggtttaactctgggagaagcatctgtacatcacaaagcattttcacagatagcttataactagttttcattgtgggacattcgattttttaaaagagacctcaatgggctataaaatgtccctttgtagattctccataaatagtgcttccaatctgctaaatcaaaacaaagctttaaccttgtgatatgaatccactcattgcaaagcattttcacataaaactttttctagttttcatcatgggacatttgtatttttgctacagtcctcaatgggctccaaagtgtctcttcataggttctactaaaaaaaagtatttccaacccgccttccatagattttccaggaacagtgttttcaacctcctgaatcaaaacaaagatttaactctgtgtgatgaatccagacatcagaaagctttttcacagatagcttttttctagtttttatcatgggatattggtttttcactacctgccaatatgggctccaaattgacctctcatatattctacaagcagagagtttccaacctgctgatgcaatacaagggtttaactttgtatgataaaactacacatcacaaagcatttttacagataccttgtttctagcttttatcacaatatattctgtttttcactacaggcctcaatttgctctgaaatgtcctgtcgtatattctacaataagaatgtttccaacctgctgaataaaaagaaagatttaactctataagttgaaatcacacatctcaaagcattttcagagacagcttctttatagtgtttattaggattttaggtttttcactacaagcctcaatcaatgggctttgaaatatctcctcatcaattgtacaaaaagagagtttccaacctactaaatcaaaacaaaggtttaacattgtgagacaaatccacaaattgcaaagcatttttacagataacttgtttctagtttttatcacgggatatttgatttttcactataggcctcagggggctaagaaaagtcccctctttgattctacaaaatgaatgtttccaaactgctaagtttccaacctgctgaatcaaaactaacattcaactccattagatgaatccacacatctcaaagcattttcacagatagctagtttctagttttcatcgtgggatattcagttttttactacaggcctcattgggtttgaaatgtacccttgcagattctagaaaaatagtgtttccaaagcgctaagtcaaaataaaggttaaactctgtgagatgaaaccacacattgcaaaagatttttacagatagcttgttctagtttttatcatggcatatgtggtttttcactataggcctcaatgagctccaaaatgtcccttcttttattctacaaaaagaatgtttccaacctgcccaatcaaaacaaggtttaactctgtgagatgattctacacattgcaaaacattttctcacataccttgtttctagtttttatcctgggatatttggtttttagtataggcctctatgggctccaaaatatcccttcatagatattacaaaaagagtattttcaaccttctgaaccaaaacaagggtttaactttgcgagatgaatccacatatctcaaagcattttcacagataatttgttgtcagtttttatcagggatattcatttctttataataggcctcaaggactcagaaatttcttattttaaattctactaaaagagtgtttccaacctgctgtatataaacataggtataactctatgagataaatccacacatcacaaacattttcacagatagcttgtttctagcttttatcacaagatattcagttttcactataggcctctgtgggctctgaaatgttcctttgtagattccacaaaaaagtgtttgaaacctgcagaataaaaacaaaagtctaactctgtgagatgaatccacacatcacagagcattttcactaataatttcttgctagtttctatggtgggatatttagtttctcaatatactcatccatgggcttcaaaatatcccttcattgattcttaaaaaagagtgtttccaaactgctaagtcaaaacaaatgtttaactctgagggataacccacgcatcacaaagcattttcacagatagtcactggaacgctggcctttctggaaaagccacctttttggtacccctcccctcatggccgtggcagtggcacagtgctgtatcctgcctgggctttggcctctgctttgtcctgcctcttgctctgtctcccctgtttctgaggggcctagatgcctctcgctctcgctgaatgtcttcaacaatgatcacaacccagtccgtcaggtagacacttactggagatccctgtcgtgatcgtttatctctttcaacctgtttctgcttgatggggcaggatagacgaccctggagctcttggcttccatacttctctcagacagggaagcttccttcctctccgtgtttcacctcatgggtgggtggattgcctggaatgagcgctagtcgaccgtgacagaccttgtcttctaggacaggtggtgtcgcatttcctctgcacttcatgtctcattcgtgagagacatcctctcctctgctcctgggtggactgagtctctggatcttttgaccataacgaatgtcggggaaaggaaccaaagggactgggctggggctggggctgggtctgcggctggttgcaggggaggttgggtcagggctacctgggccatggagggttgggggtggggtgaattttgccaaaacctctttaatcctctggcaggcatttcaaaatgtggcttggactaaggcacaggcaccctcctcgttcccaggtgttctttgattttccttggcattgatggaaaggtcactcattccccccttcgaccgggcacattcctggacaccattgttggtttcgccatcacaatgtatgcctccggtgacacacattcacaccatctgctgtgggatacaccagtgccacgcgtggtcacatggtctccatctcggattcacccctgatcctctttctaccagtcccataaagcgcggtcggctttccggagccccagggcttttagaagcggggcaggccactgctctttcaaaggaggaaggaagcagagggctgatggatcagtgaaagtgcagctgacactaggccttgagacttatgggattattctgtgctgcagcgaggccctacggcctcaccagatgtagtgagcccatcctatctcattcagcaggccaaaatggatctgaaggggagtcctgagaacacagcaagcctcctgaagctcccgctccatcggtggaagtcggctcaaggaggtcctgaggacaggactcctggggcttttgccctgggacaatatacccggggcccctctcccacgctgcctcaaattggaccccggatgcagccgactccgcggctgcagcaggagcctcgctgccaccccgcagcgctgccattatttaaaggggacgcagcctgactgccaggagcggagcgcgagtccgcccagccaatgctcctgggcgaggcgcgagtggcttttcccatcacagtggttccacggttgtcttagaaaccagtccccgaggcttagaaaagcaggagccctccgcggcagtccatgggtgtcagggttctgaggctccggcctgacctctccacggggtcgacgggaacgtctccagatgccaggagtcgcaaagcgccaaacaggatgaggaaaccccaggcggagtccgggaaaagcagcacagcatcccagcctcaggcctgcccggaccgtgttggttgggttgactctccccaaaagtcgtgccgccatccgtgatctctaagacaggtcggcctgcgtgcccctgggctgctctctcatccgagggtcgttctcgtcgagagtagaatcccgcagtctcaggggttacctgggggtgtgtatttcaatacttctgctggatgactctgtgtgtgagtctgtgtgtgtatgtgtgtgtgtgagcctgtgtgtgtctgtgtgtgtgtctcccattctctcttctctctctgtctctcagtctctgtgtgtttctttcccactctctgtgggtttgtgtgtgtgtgcccttgtgcgtgtgtgtctttggctgaatgtgccctgtgcaccacacagcggtttctcgcatggcggcctgtctttgttgagcctctttctgcgtctctgcctgggtcatgaggccggttgtcaatcattttcgcccccgcagatctgctttgggtgggtgaaagcctggcccacgtgaggagatgcttcggtcccggagcaattgaagtctcatccccatcctgagtggcctcttttctaggatcaagatgaacccactgcagacgaggacaagagccccaacaggagctctttgtcccacaggagagcagcggacccacgtcagagaagatgcttgtgtcttttcatggctcttctctgagaaatgaagccacaccacgatacagtcagcaagaggaagccaggaatgagagatggcaacaatccctgtccctggaacgctggcctccctgcacaagccaccctttaggaaccccaccccttatgcctgtgacggtggcaaggtgctgtatcctgcctgggctccggcctctgctctgtcctccctcttgctctgcctcccctgtttctcaggggcctggatgcctctcgctctggccaaatgccttcaacaaagatgacttcccactccgtcagggagacacttcctggagacccgtgtcgtgattgtttctctttcaaaaagtatttccgcttgattgggtaggtctaatgacccgggagctcttggcttccataggtgtctcaggcagggaagcttccttcttctccacatttcccctcatgggtgggtggattgcctagaatgagctctaggcgaccgtgactggccttgtcttccacgacaggtggtgtcgcatttcctctgcacttcctgtctcattcttgagggacatcctctcctctgctcctgggtggactgactcccttgatcttctggccaaaacgaatgtcagggaaccaaagggactgggctagggctgggggctgggactggggctggggctgggtgcagccgatgttgcgtcagggctaccgggttggtggaggattggggttgttgcgaattttgcagaaacctctttgctcctccggtaggcatttgaaaacgtggcttggctcaggcacaggcagcaccccgacccacggggtcacaggtgttctttgattttccttggcattgatggaaaggtcacctgtttcccccttccacctgcacatgcctggacagcaccctttgtttcgccatcgccctgtatgcctccggtgacacacattaacaccaactgctgtgggataggccagtgccacgcgtggtcacatggtctccacctaggattcgcctctgttcctctttgcagttgacctgtaaagcgcggtcggctttccggatccccagggcttttagaagcggggcaggccactgctctttcaaaggaggagggaggcagagggctgatggatcagtgaatttgcagctgacaccaggccttgagacctacgggatcattctgtgctacagcgaggccctgtctgcctcaccagatgtggtgagcccatcctatctcactgggagggggccaaaatcggatctcaacgggagtccggagaacacagcaggcgtcctgaagctccccctccctcagtggaagtcggctcaaggaggtcctgaggacaggactcctgggggtttgggcctgggacaggacgagacacccgcggccccctctcccacgccaccccaaacaggacccaggatccagccgccgccgcggcggcagcaggagcatcgcggccgccgcgcggcagtggcgatatttaaaggggacgcagcctatctctcaggagtggagcgcaaatcgtctcacccaatgcgcatgcgcgaggcgcgagcggcttctcccgtcacagtggttcccacggttgtcttagaaaccagtctccgaggcttggcgaagcaggagccctccctggcgtgcttgggtttcggggatctgaggctccggcctaacaacttcacggggtcgacgggaatgtctccagatgccaggagtcgcaaagggccgaccaccatgaggaaagcccagcggagacgggggaagcagcacaggaacccagcctcaggcctgcccggatggtgttggttggggtgagtctccccagaattcgtgcctcggtccgtgatctctaggacagttcggcctgcatgcccctgggctgctctctcgcccgagggtcgttctcatcgagagcagaaccccatagcctcagggattgcctggaggtgtgtttttcaatgccctcctcctttgaaagagcagtggcctgccccacttctaaaagccctggggctccggtaagccgacagggctttacaggacacctgcaaagagaaacaggagcaaacccgaggcagagaccatgtgactacgcgtggccctggcctatcccacagcagttggtgttaacgtgtgtcaccggaggcatacggggcgacggcgaaacaaagggtgttgtccaggcgtgtgccggtggaaggggaaaacaggtgacatttccatcaatgccaaggaaaatcgaaaacacctgggacccgaggggtgtggggggggcctgtgactgacccaagccacgttttcgaatgcctaccggaggagcaaagaggtttctgcaaaattcgccccaaccccaaccctccaaggccctggcagccctgacgcaacttcggctgcacagagccccagccccagcccccagccctagaccagtccctttgtttcccttacattcgtttcggccagaagatcaaggggttcagtccacccaggagcagaggagaggatgtccctcaagaatgagacaggaagtgcagaggaaatgcgacaccacctgtcgtggaagacaaggccagtcacggtcgcctagcgctcattctaggtaatccacccacccatgaggggaaacgtggagaagacacctgcctgagacacctatggaagccaagtgttcccgggccatgagacctgcccaatcaagcagaaacacatttggagagacaaacaatcacgacacgggtctccaggaagtgtctccctgacggagtgggaagtcatcttagttgaaggcatttggccagagcgagaggcatccaggtccctgagaaacaggggaggcagagcaagagggaggacagagcagaggccggagcccaggcaggatacagcaccttgccaccgtcacaggcataaggggtggggttcctaaagggtggcttgtgcagggaggccagcgttccagggacagggattgttgccatctctcattcctggcttcctcttgctgactgtatcgtggtgtggcttcatttctcagagaagagccgcgaaaagactcaaacatcttctctgacgtgggtccgctgatctcctgtgggacaaagagctcctgtggggctcttgtcctcatctgcagtgtgttcctcttgatgctagaaaagaggacgctcaggatggggacgagacagcaattgctccaagaccgacgcatcttctcacgtgggccaggctttcacgcagccaaagcagatccgcgggggcgaaaacgattgacaaccggcctcatgacccaggcagagacacagaaagaggttcaacaaagacaggccgccatgcaagagacagctctgtggttcacagggcatattcagccaaagacacacaagcacacgggcacacacacacaaacccacagagagtgggaaagaaacacacagagactgagagacagagagagaagggagaatgggagacacacacacacacaaacaaagggtcatacagcagaggcattgaaacacacaccaccaggcaacccctgaggctgcggggttctgctgtcaaccagaacgaccctcgggtgaaagagcagcccaggggcacgcaggccaaccggtcctcgagatcacggacggcggcacgacatttggggagactcactccaaccaacaccgtccgggcaggcctgaggctgggagcccctgctgcttcccccgtctccgcctgggggagcccaccacctacccaccctccattcacctcccctccttaaggctcactaagctctatttaccttttgtaactccatccctccgtaagtacacaactctcctagctggtttcctagagggcagatacagtgtttccagttggccctctgcagatatctatgaacaagtctctcccagcccctacatataaatatgtgtgttctagacagacgggcctaagtcccaatgtaaacacatcacaagataattacaccttatatgcatacagatctctctatagagttatatttgaaagtgtctataactctagagagagattgcagcatgcacatataggactgtaattacttatatgtatttttataactatgtagttataaatagatatgcctatatatagtgataataatatagcaatatctccatagccatatatggctctaaatgaatgctctaactactctatttcacaatcaataagtatatatcttctgatacataattctaacaatatacgtttttatctatatagctgttcagagatataaatctgtcaggatatcaaatgtacataaagctggatggctgtaagagagtcgtatattttcccatatataaatctgctcctataactactgtatatgcacaaatacaatggaaatagttatatttccctcaaacataaatctgtaaatacaaccacagcacatttaggtacggttagacatagagcaatatttcctagatatcagtctgtcaatagagccacagtgtctccaaacagagagttatagagggagttataaataaactctccagatgtgaacggatcagtagaactagatgtaaacatgactccaagccgttctttcttcttcttcttctttgtaagatattcctgaagcaagcccagtcatataacagggtgcaaaggtgtctgggtactggtatttttccccccaaggagggtcggaagtcgctggactttgggaaactgagcaggagtgggtaggggacagtgcccgctcccaacgcaatccagaagccccttccgtctgtctcctggtggctgagagctcgggcaagtggagaggcctaagggagaaaaatgaaaaagcagagtctggcttgagtcgtttggcccttctgcctaaaaccctctcaacagggaagccccgaccaggcgtcggagcggagagagcccacgaggcacagaggttgggagaaagggtctgcaggccgggcttcggaggcctagcggagtcgccagccggtgcctgaccgcccggcgccccatcgcccagggccgctgcctcgccgcaggcctgaacacaaaacctgggccctagccctgcgccctgtgctcagcacttccactggtcttattttattgctgtttgtccaattaggtatcgcagcgtcctccaccaggtgttgttttcaaatgtgagggcacccagagctttctgaatgcgtgtctgtgtgtgtgtgtgtgtgtgtgtgtgtgtgtgtgtgtgtgtgtgtgtgtgctggctttaaataagtgactcagtggatagtgtatttctcttttcagaccaaatgtgtcactggctactggaaaagaatccagacctctgaaagggttcgtgacaaattttttagaagttctcacgctcatttgttacgatgattttcttttcttttttctcttttaaaaaagttggctaatttgtgcttctatattcctctttaattttatttttattgggggtacaaatgtttttaaaggagggattttgttagacccgaaactgtggggtggcttcctctctagcaaacttattatctctacgcctgtgattcccatcaccgccaagaaaacaaactaattaaacgaccagaaaactgtacctggagaaaatgaggtagaagttgcaggatccgggaccgcggtctttgcttgcttcatgaaaaatcggctagtctccaaactcgcgaaggaatattcaaggtgcctcaactcctccttttaaattttttaataaagagcctagacagggaactttccctgggcctgccagagccccagcctcgctctcccaacttcccagcggccataagtgtttttctgcttccgttcgggccccccgtcttcccgggcatctctgagctcctgccggatcaaggctgtggtcatcacctcattcatctctgccgcttggcctgagcctgcacatttggcctcattcttaaaacagaggctcctggagagtcccaaaagccactaaccattcccatatgtgggatcccttctctgatcacacaaagcagaagcctgagaaaaaaagcaataaagagtggtctctggctctccttcccctcttccgtcccttgtctgggaaaggggttcccaaccccagccccaccaagagcatattaagatttcttcctcccttcctttcctatctccccctcagatgctgtgatcctgactccttctgtctccacctcaaaatatttcctcttgcattttattgttattctgttatggagggactgttaactactgttttattattattattcattatttattgttattatgattgttgttagagatttgttcaccactgttcaggggacagcagcctggcccagggggaagcctgcctctccctctctgtctctctctctttctcacacgcacatacacacacacacaccctaacacagtgcacactcatgcatatatgctcacaaatgcctgctgtgttcaggcccctgcacagcaatccgaagaggcaggcatcctaccgcagcactcaaacaacacactgcccacgcacaccagcattcaggcagaacaccacccccagaccaacgccaaaacccacacgcaccgagcttgcaaggaaaggaaaatacataaagaatcccttctctccacaacctggaggggcgagtcaggcctctgtctcttccccccagtcgctttcgctttctctttttttttttctccttgtttacagcttcagagagctcaaggcacataaatcttgagggttctacagagcgcagagcacatttgtatgcatcgttaggactcgctaatacctaagcccattaaggagcgtgtatgcgcgtggtttccggtgtgtattaacttatagttaaattctggaggaaagggcattgtgaattaacatataccaaatccatcatgggcttttgtcatatcagattagtcagtcatgggtttgggggagcaacttgcctgggttggtgtgtacccacccttcaaactttgtggagcaggcccaggggtcttgggaaacacgaaggcattcctatccagccccagtcattcggatcccccaggcctagcggccgcacacctgcgagatggcggagggactgcagacccgggtgcgggaggccagcgccggcgaagagaggcgggggagggaggcccctccagcgtcctgctggggttgagttggggcggctcgtcccatggccgctgggtcgtctggtttccgctttccgaaagaaatgagaggagaggcaagtggagacgctgaactttaatttaaccatagagaagacagtggggggagggggaaaaaagatcggagaaggaggaggaggcggccgagagatcgaggaaaggaagtcctggcggctcgggggaacttggagatctctccaaggggctgaaagctggaagttgtatgaagatgttcctttcccacatcccagctactccgccccagtcgaagagactaattccggccctcttataaaaataagaaagaaaaggtaaagaaaaagaaaatctaattatgtggcatgtttcagccaggtgttcctggttccaatgactcagaccctattggagccccggggatctggataattgggcatgcatagacagtgatgaaggatgccatttctaaaaggaggaaggggagaggaaagtccatctcttggggtcttgtagaaaatgccaaagaccaaacaagctaaattattgtgtccgtgtagatctatttccctatttacatacagcaggctgtgggggtgggggatgagggaagtccaggaataaacgaccaggctggagctggctggcaggagagaaaatgcgccccctggccctttgcaggaacagccaaggggcctcctcagctcgcagctcaggcggccttgcggcggactggtccggggccgggggcggggccggcctgggggaggggaggcgggggcgggaggggaggcggaggcgactctccccgggcgctatgaactttagctgggccgccgcctgtcagccccagaaagcgttaaaggtgcagcagcccgcgccagcctcctcagccgcctttgtatgcgtgatttatgacttcaatcttggttcaccaagagttcacacggctttcgctgctgttgaaggttaaaagatggtcttcccttgacaagtgggactattgaaaattccttcttcttctttttttttttttttgccaaaaaaattattcactgtttatctgaaattcacatttgactgagggtcctatgtttgacctgacaactctactctttttgtttgtttgtttgtttttgttttttgtttgtttattttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattaaggagtggtgatgactcttaacgagcatgttgccttcaagcatccgtttaacaaagcacatcttgcaccacccttaatccatttaaccctgagtggacacagcacatgtttcagagagcacaaggttgggggtaaggtcatagatcaacaggatcccaaggcagaagaatttttcttagtacagaacaaaatgaaaagtttcccatgtctacttctttctacacagacacagcaaccatccgatttctcaatcttttccccacctttcccccttttctattccacaaaactgccattgtcatcatggcccgttctcaatgagcttctgggtacacttcccagacggggtggtggccgggcagaggggctcctcacttcccagtaggggcggccgggcagaggcgcccctcacctcccagatggggcggctggccgggcgggggctgaccccccccacctccctcccggaccaggctggccgggcggtggccgacccccacctccctcccggatggggcggctggccgggcgggggctgaccccccacctccctcccggaccgggcggctggccgggcggtggccgacccccacctccctcccggatggggtggctggcctggcgggggctgacccccacctccctcccggacggggtgccgggcggagacgctcctcacgtcccagacagggcggctgccgggcggaggggctcctcacttctcagatggggcagctgccgggcggagggtctcctcacttctcagacagggcggccaggcagagatgctcctcacctcccagatggggtcgcggccgggcagaggcgctcctcacatcccagacggggcagcggggcagaggcgctccccatatctcagacgatgggcggccgggcagagacactcctcacttcctagatgggatggtggccgggaagaggcgctcctcacttcctagatgggatgacggccgagcagagatgctcctcactttccagactgggcagccaggcagagggactcctcacatcccagacgatgggcggccaggcagagacgctcctcacttcccagacggggtggcggccaggcagaggctgcaatcttggcactttgggaggccaaggcaggcggctgggaggtggaggttgtagcgagccgagatcacgccactgcactccagcctgggcaccattgagcactgagtgaaccagactccgtctgcaatcccggcacctcgggaggccaaggctggcggatcactcgcggttaggagctggagaccagcctggccaacacagcgaaacaccgtctccaccaaaaaaatacgaaaaccagtcaggcatggcagcgctcgcctgcaatcgcaggcactcggcaggctgaggcaggagaatcaggcagggaggttgcagtgagccgagatggcagcagtatagtccagctttggctcggcatcagagggagactgtggaaagagagggagagggagaccgtggggagagggagagggagggggagggggagagggagggggagggggagagggagagggagccttctttttttttattttagaagcgaagagcagaggctcaggtgaggaaaaaattggggggtgggtgtgcgggggacaggggttgcaggtgggccaaaatggtaggtcaggaaggtttgtcttcctatatttaggattttttgttgctaggatttgcgtgcatgttggagagaggttagagaataagagggagataggcaagagatgtaaagatctctcatatttagaggccaaaggagtgaaaaaaaaatcgtgcttccacagttaattatctgggtaacttgggtcacaccccctaactgatcctcctctagagaccagaaatgggccaggtaaggggcagagttgggcaaagggtaaggtttgtgtgcttctcactgggtgtacttgatcatccaccttacctgggtaactacttttttttttttttttttttttttttggaaatgtggtccagctctgtttcccaggctggactgttgtggcaccatcatagtttactgaagcctcaaactcctgggctcaagtagtcctcccaccttagcctcttaagtatgtgagactgcaggcatgtgccacaccgccaggctgggtagctgcttttcaatatgcttctgcacccacagatttggaaaagggcatttttagacagcagtctttcaactctcttcatcctgtaggtttagcctgccatttacatttgatgcacatgaaaaggctaatgggaaggaaatctatagaattgtaattggaagacctttcaaatcccaaattcccttggtctaagagccagtctctcttctttctagcattttgacaaaggtcgtgccacagcagaggtggtggtcaaagatctcctaaagaccaggatctaaggcccctttgtgatctaaggctctgagtacttggagagacaaaactcactccttctttgtagattcagagagacagagagagagagagagagagagagcgaacgagagagagagagaatgaggagataccttgaagctgagggtctgcttggctcttcgaggtttcttttaagatatgtttttaaaaaaatttctggagtgggaattgggattgtgtgcactgggaaggggaacagcagagagctgggtcgggagttgggtgtgcctccctagccctatttaggccccatctccattatcaatactaggtaaatgtcttaagagatagagccagcccctcaaatccagatctgggaaccaaaggcatccacgctagaaggggcactccctgcttctctttctacatagcgttagagaggtattttcccaccatgtgaggacttagataagagaaggagaagagccagaaagatgtccacatctcgccgggacacctagcaccaggccctcctacaggggacctcgtatgtaaatagcagaatggggagcagagaacagagagacgccagaaatccagagtccaggctctgaggtcactttggtaggaatggtcctctggccttatgaagaacagaggggcaatatggcactgtttagaagctcagggggtggtagctgttaggaggaatcagccaaggaagctaatgaatctcttccgggttctggttgggaagcagaggaatgaacttaacggcctctggaagtaatgtctgtactgaagtccccttcttaccctttctgactgtgttcctccctgggaaataattccagtaggcttgtgcttatctgcaagtctggggtaattatgaattattaattcatcattaagacttgattgtgaccgttgctctccagtggacccatttatctccttctttgtgaggcagaggggagcctctgttagcccttggcttctgtaacaggcaaactgaggccagcccctcttgaaggcagtccttgaactctgccctaggtgggatggttgcctcattaccagtcaagtaatgttgcacctcagagtatttgtgcaatacagccacttcccacaaacttcggatttcaaagtgctttgtaggctcctggagagatagagtagcggattgggagtgagactccaacaggggaagaaacttggccaagctgtgtgtggagacaggaattaaggtgaggtgggaggactcccaggcacagtatctaagcaatctgggatcaggaatggtcattttgtcttccttaccctaaggagatgctagtttccctcaactctctggggacccctgaacacacatctggacccttttcctgatctctctttcccccaccagcctctcaatcgagaagcacaggtttcaagtcatatcatcccctctgatggttaggggtgggaaagtcagatctgccggttgtttcacatctgtgagaggcctggagagggagaaaattgctcctatcccatgaggtaatgcccatctaaatccctgctgtaaactcacctcccccagcactgaaacaattctcttcatcctttttttcccctcttcttccctctggaaccacagacagggagactgagggtaggagatgcagctcccaacagctgtacctagaggaagagacagcagtaggaaatgaggggagagtggcttaaacctgttatttcccacaaggtttatctccattcttcaaacccaggtcaacaccctaaaaccagagccatgggaagccctctctccttgttcccccaactctctctctctcacagaaaaggagccctgtgtccctccctgaggccaaggggcttctctaaaaactgctctaagaacactaccactttctacaggacacctgaagtcccaacccccatgtatctctcagtgcctgtctggtccagagggagccagtggctcttgccaacacattaccattttgtgccccacgatgggggtggtccatggagtcatctcagctttcagcccagacctcactcactctttctccaagccatgccaacattccttggtctctccaaagccaggaggcaggtaggaagcccatccagagggtcccctggaactggctaatatagtttaatttactgtttggtggtaaatcaagagaacttgggaaaaaagggaaggagcaactgtgcctagcatctttctcagccacccctcccctggacattggctttctccatgaaacagtgcactgttgttcttggacaaccattccccaccatcttcgttggaagggcttgagtttcaccctccgttcacccccattaatcaccccagcagctaaacatcacccagccccctctggccctttctcttcttgcccttagtattcatggcggagcattcctcactgctgcacgctcacaaagacccctcctctgacacgaggtccctcccactccccaaccacccagtccacgatgggcactgctcactgttctggatgttccaactgccggcgcccactcctggaccccgttcccccactccccagctatctccatagcgactgcccccttcccatgcacttgttggcttaccacaccctccttcaggtaactcctcttaaccccacaaaccctcttcagtctttcccagccaccattctgccctccatgccctatgcatgtgtagcccttgtctgcttctctatacttctccttgcttctctcgtctttccttccccaagacattccgtaggcacttcatatggtggacctgaagcccttcccttctgaccttgagaaagtgagaggcagtgtaccacaggggttaaaagcatgggtttgtgattcaagtccctgatctgacacttgctagttgtacaaacttgggcaaattacttaacctctctgagccatccataaaatagacatacccactgaccttatagagttgttctgtagatcagattaaattttatttgcatagatccaagcattcagcaggggctcgataagtggtagttattgtgttacaagcttcttgtgaagaaagagagatgttcttcaggttctaaaaagtgaaggaattgcctcatccagcaccagagagggagggataaaaattacacagtcttgcagataagcagggcccatttaccaggcagtgatactcttctattagctctagagggtctcaactttcgctgcacattggaacccccagcgagtttttttgtttgttcatttttgtttttgagatggtgtcttgctcttgtcgcccaggctagagtgcggtggcacatctcggctcactacaacctctgcctcctgggttcaagcaattatccctgcctcagcctcccgagtagctgggattacaggtgcttgccaccatgcccagctaatttttgtatttttaatagagacggggtttcaccatgtttgccaggctggtctcgaactcctcacctcaggtaatctgcccaccttggcctcccaacgtgctgggattacaggtgtgagccaccatgcccggccacaagctttttaaaatactgatgcctgggtcccacctccagagattccaatttggttggcctgtagtagggcctgggcatctggatttttaaaactccccaggttgataatgtgtagccagaggttgagttgcaggccctaggaaatgatacaagagataaggggagggctgacacttctgccagagcaagggaggggagggatactcagctgagagctgcttctcaaccttggacatcccctcaccagtggcactgcttcagtcggggaggttttcacttagaattagcttctcttgagatcccagaatttcagagactctcacctttttcatttcctatagctattagaatttacaaaggggccacccaaagaggagacagaggaattgacaaattgacctctaagaggctcatctcttatcagaaaagcatatggtccccagaccaccagtgatagaagcagaggcagatacctccagtagtgggaaaatttgtaattacatagtaaatggagtttctacctggttgctacaataataggccaagcaattaggatacaagtttccaggaccttttcctatatttccaaaaagataaatcacccctaggaacagaatctgcatattgtaattacctgataaatatttcatgcctggttcaaactttctcctcttctatttaatggccacaaacttgagcccagaggaaacaggagtgaggagagtgggggttggctgtaggggggaggttctaccttggcttcagggagggagaaactgtcttagttaattatttactgtcctcctgttcttttaagaaaacattgctcacctggagaaaatcatgtcccaggtggtaaagggtgtgacttgggcttgttggcctcagccctgacctcccccaggagaggccaggttttggtgaccctgggggtgctgggaactgcaggctttggagtcaagggcccagtgtttgaacaagagctctgttctgtcacttattaactggatggctttaggtaatttacctaatctatgtgaaactcagtttcttcatctgtaaaacagacataatttttaccttgtagggtggccaatgctcagttggatctcaatgcatgataactattattatcaacagtaacaatgaataattaatagcccattggattgtaccctttcccttcctcaaccttgctccagtgtgtagggcacctaaactactgaatgcttactgcgagtatggtgaatgccttagctcaattacacaacataattctttgaagggaatatcttatcatccctacttatctgtgttttgcaaatgagggaacagggcatgtagaagttaaataccctgccaggtgtcacacaactaagtggttaagagcacaggctctgcagtctgactgtgtagtttcaaatttgggctctgccacttaataatagactctccttgacttacgatgaggctgtgtcccgataaagctgtagtaagttgaaaatattgtaaggtggatatgcatttcatacacctaacccaccaaacatcatagttcagcctcgcttaccttaaagtgttcaggacactttcatcagcctacagttgggcaagatcatctagcacaaagcctattttataataaagtgttgaatatctcatgtattcaacatgagatatttattcatctcatgtattcaacatgagattcaacatgttataatatactgtactgaaagtgaaaaacagagtggttgtatgagtattagaagtacagtatctaatgaatgcatatcacttccacatcatcataaagctgagaaattgtaagtcaaagcatcataagtcaaggaccgtctgtaatcactgcaggatggaacataaactgcttaacctcgctaagcctcagtttcttcatctgtaaattggggatatgaatggtacctacctgaaaggtagttgtgagaattaagtgagaaatgcgtgtatagtgcctgtctcagtactggcatgtggtaagtgcctagtaaatgtgagttgtcagtaccatcatcatactacccagcaactcagggccatggcgtctcctgctctttggtggtgtttgggagatgagtgagtgtgagggtcctccaaaggtcacagagctgctcttttaactccccctgacagacacacacacttcagtatctaggactcgggaaaaaggacactaagcagattatgactccatttcgggaattaaatcaaaactcaagactatctcaatttggcttctgacgagagggaaaggttaaaagggagtgaggaggcggttgagtgtgcgtccagaattgcaattggttctggatcccacctcccagctcctccacagggccaggcccaaggagtatcccccccgggggtggaggagtgaaggagccttagaacctgtgttatctgaatgtgggtgaggtggggagaacatggtcaaggagttgggaaattatccagaaacattttccaaagggagatcttcccgcataccacctcagcctggctctggattgcaggggaaccccagaacggatggggtctgggggcttaagacaggtaggtggcctcagtagaggggagaaaaagtcctgctggagacagtcgcctccctggagaaggacctgggctagtgttctctttaaagacgtctaagcagtcctggtatgctaaaaacattatgtgtatgtgtataaacatatattctgtgtgtgagtagccactcagctcttacttggcttcgcacatttggcccagattattctgagcattgtaaactaaaagtgaaattcggtttctacttaagagagagcgtgattttccccagtattatctcctgtgcccccaacactccaccaggctttaaaggccattatacagaagggagaactgagactcaggagattgatggtttgttcagaatcgcagaagcagcgtggatccaagaagggatctgctcccaaacagaaaccagtgtcttgggagagagagagcagaggaagcccgcacctctgccctaacctgaggctttgagcctcccgcaaagccgagtgagttgagagcgcctggaaggcagacgctgcggagggagggactcccgggctcgccaaacagcggggcctcgggcaagagcgtcgctggcgcgtcctcattctgcgattgctgtcaggggaccatccatcagcgccgccctggacgctgggccagactgcccgccgcccgccccgcccgggtctctccagatcgcattagcgtggggcgagggctcagtgcggcaccggctgctgagggagaggcgtggcggggaggagggtggtgcggggggacgaggacatcgctgtggggacactgcaggggcaggggagaggctgctttaggaccctcctccttttcttccaatctcccgcctctgggatctaaggtggatgaaaggggcactagaatgggagacttttggggggcagggggcgcagaacactgaaggcatcagggaagagtagtgatgggggcagttaccagaagcagagaggaagaaatacctgtaaaggggaaagccagataaattgtctggggaggggagagactgaaaatgggggtgcagagattgggggttagtggaagaaaaagacttaaagggaaaggaaaagagaagctgtagagggaaagagaattggcaaggaattgacgagagagcagggaaacaggaaaccacagatcgtcaggggccgacaaaaccttagagacaatctactgcagcccctcattctacaaatgaacaaatggaggcccagagaggggaatcccttctccaaagacccactccacctgctggctgggcaggctcttgaccacaggctcattcattcaacccatgtgttttgagcatctgctgtgtgctgggcactggactgcctggatgatgcaggatcagctcctgccctccagaagctacagtctttcctcaggggcttggagaggctgagcatccaggaagctccctcacccccagccaggagggactccctgagccccacctctcctggccactgaaccttcctttccctctgctgttctgcttatctcctcatggaggatggccgttccctggaagatcttccctctccactttcctggggactccccaggtgtggagacaggtacttgacagtttggccaacttgttctatctcccacagccaacagggtaggcctaaaagcaaagtccatattccttgctggggttctcctctgggcatggacaaatcccacaggttgcactgagatccaatcgagctgtggtaaggaggattgaggctggacatgaagaagtacttccaggtcccacagtctgggaccattttcttgctggggctttaaagtagctgtccttctgtgagcacagtgttgtcaccatcttccagggaaggacttgtcttcctcagtctccagttagccttgtgcgaggcattatgctgggaatgttggggttccagatacctggtctctgaccatggggtttctgctctagacatgggtgaactgacatctccctggcatcctcccagtcactgccagctctgcaacatcatggaacccctgagtccttcacaactcccagatcatctcatccttcctccttgctctgggaagaccatgtctgagtagttccaaccaacctctcaccttaaacccagtccctgacaaccagaagtgcctccttagtctggacttgaccttccttgctgtcatggtccatcagcaatgaccagggctgaagcagcacgttttttctacaaacacccctccctcccagtgatgctcacccaatccccggtggtcaggcagggagtggggacagcttcctgccaagagctctggaaggcagctctgcctcctctgcctgaagcaagctcctgtatactctgagatggtggtgttcattttaaagaagggaccatctttcctccacagtccagcttacatttggagggagacaaatgtgagtttccaatcccagaatctttgccactgtaccaatctccatggatgcatgggattcaggaaaggagagaaatgagcagagcgaggacacgaatagaatccgtttcctaccccttgttccagcccaactcccagggaaaggccaacagagggcaagagaggtggacactgaaaattccagactaaagaccaacagacagatttcagcattattccttcttgtaggcaaagtggtgcctaaggatctaaccaaatgaaaaagcctgggaaataggctatttctgcaccccctgaccattcatgcagagcaggatatcggcttcagcccagaagcaatgctagaagttgagaggtttggagtagactgtgaagcagttcctccaagtgcatgccagatgagggggttggagcacccagcccagaacagcatccaaggaaggaggccttggcgtaactctctgtgtctctgtgttaacttcacatacattgtcttgtgtgatccttactgccaggttcagcaccaggcacagaatacatgcttgctgtacaaatgcataagtgaagagccatgggaggaaggtcaggatcctcaattttagatgaagaaacagacacacagaaaagttaaatgacttgctcaaggtcacatatctcatcagagacagggccaagtttcagtggagagccactttagtggtagagggtggtagggaggagggaggcaggaagggagagaatgaaccatcagacaccacaccagggggagaggagagctgtcatctctttctctttgtgaaaatatattacttcctggaaaagatggcatttaagaccacacagttttaaaaataacccattgaaggttgatttgtagcatatgcaaagttctgccaaaaacatggagaggtcaatgagtagatggggtcattgaggatcagaaaagaaagacaacactgaaagtctggacagctaagccccagaattttgctagtcttaaatgctgggtgacatcaggccagccacacccctctctgagcctctagagaatggagatgccagatgtggaggagggtacacatgggcaagaggaggcaggtcattgccttcagggtagcaattggaggcatcaagttcccacttccctagacctattctttgttgttattattgttgttgctttcctctgattttaatagttttatgttttttgaataggaaatacatgtacatggttcaaaacacaaaaggcaccaaaagttatacagtgacaagtaagtctccccggaacctcagaactcccaggccacccatgtcctcactccattataactgcagtaaccactgaattgtataacctccaaaggtattttctgcttctcctggcttgtaccctgaggccatcacaaaactgagttgagcactgatattctgaggagaggtggtacacatgttttggcccctggactggtggggccttggaatactacatactctcagtttccactctgaaaagatgcagaaacttgaggtcaggagagaggacatttctgcatgcttagaagctcagaagcctcacaggtgagaggatggagttgggagccaggcagaggcaggaagcctctcaggggctctaataccacactcccaccccagagcctcacagtgccctctgggttagcctggctcaggtatgcacccagttaggtcctgctcaagttttccagagaacaaggcccagtgcttcccctccaccacctgtcacattattgggaggccttccttgatgtctcattctagttccttcaactttaggtgcagcccatggcttttgattctgccgtcagtggagatggaacatgctcttggagatgatagcttccagggacccaggctcttcctcccacttgcatacacaattttccttcaggccctctaattccacctcaatcttttttccagacttagaagacacatgcctgttctttcagctaccctcccccacctgaattcccagtgtgcctccattcccaaccacctcattcttgccctgcacatccctttggcattattatccccaagtatgctttggtcatgaagatggtaaaatcccaacctaaagccaagtcctccaccagattcgggaggtaaatccagcctagtctctttgttaactgaatctctccattttaggtgatggcctagcccaactcatgaacttgtgtccaacactctgactctcagatcctcacacatggcctgttgtgagataaggcacaagttcaccccaagcctgggatggcctcccctctggtctcttctccaaaccctcccctggtgaacctcatcctttgcatttacacactaagcaattaatattgagcactattctaagttcttagaatacattggtgatcaaaaccgagaaagaccccccgcctgtgtggagtttacattctagcagagagagacagataatgaacaatattcttactaaataagtaaattatatcatatattagaaaatgataattgttacagaaaaggaatagatcacgtacagaaagatcagcatggaggggaaatctgaggtttttaatatggttgtcaaggagatctcactgagaatatggtatttgaacaaagacttagaggtgagagaggaagtaaaccccatagacatcttggcaagagtattccaagtagagggagtggctggtgctaaggccctgaggcaggaacatgcctggcaagtctgtgggagtgagcaagagtgggggcagatggcatcagagaggtaaggagggaacagatgatgtttggcctcgtaagtcaacttaaggactttgctttttactcggagtgaagtagagaggaaagacatgattggacttcagggtcttgctttgttttgagagacagtctcaccctgtcacccaagctagagtgcagtgccacaatcttgactcactacaacttctgccacccaggttcaagtgattcttatgcctcagcctcccaagtagctgggattacaggcacctgccaccatgcccagctaatttttgtagttttagtagagacggggtttcaccatcttggccaggctggtcttgagctcctgacctcatgatccacccaccttggcctcccaaagtgctgggattacagtcgtgagccactgcacctggcctggacttcagtttttaaatagtctttttgtgttttgtgttgagaatagatcacagggggccaagggaagatgcagggagacttgttgaaaggtcattgcactaatccaagtgagaaatgtgtggcttggaccaggatggcagcagtgcatgtggtgagaaaggcccaaattctggatttggtggcagtttcctcttccttggcttccatccttttgctctctttgcttcctctcttcttttctaggttgtatgttttctctcttcttgaatactgagagatctctgtgggtggggctcaatctctgttcctgggatctggggcaggaccccaggcaaaggacagacaggcaccatgttgtctgggaacaggctgacaagccatgcagcttcacagccctccccagttacagggtccctgagccaaggggaagagactgctgtttctaaagaggatgtgatggacagttattgaggtgcttagctgggggctccactctagtcttaatctgagcagccctcaaggaaatcataaccagctcttaaaaacatattgagaccaaagcttgtgcgtgtgtttgagcggagcttcagacagctacttaacactgggggcctctgggcttttgattcctccacttctagcctgccatctccccccagctggctggtgcttatcagccaagacgttgtttaaatcatactcatttcctataaccatttcacttgaaatgccatcctctgctccagaaattcatctatcaccagcctaggggtatagttgaggagccttggggtgatcgctccccatctctacccctgcccccagtcacccctcttcccatgacccatattctcaggtttcacgccataagatctacttcctctccgtgtaacaggacacttagtgccagaattatttataacattgagatggcaacagggcaatggggagcagcccaacccatggacactctctctttgaaagctcgatcaatggacctagatcactgtttactacttggtgtctcggcctctgctgtgtttcctgctggctttgggggatggggaaacaggggtctggaccaggtcaaggctgttctcagagtttaagatgcttataaaccaggcctctaataaagttatgccttcactgtacctctattccttggccaggcacttccctgcctcaggtgagctctcttcttggaaatgaaccattcttggggctttttcgcaaacaggagccctcttcctcccccaggaaagctgacattatgtccctaccacagtggcagagctaggacttgagctgaggaagtcatctgatatggatcagaatggggatgtggaagattccgggagttcttccgaggaagggcttgaattggccccacccagtctggagtggaggtagaggggtggatgaattcacttcttcaggactgaaaacctttttaccatcctcttcctccccattcatagccaattactcgttgtcctaatttgaaggctctgttgtctggactggaggatttttacccattttccagcccctctccaggtctcatttattggggcagtgtcacattaaagacattgccagacttcctagtccttcccaaaggcctgacccaactccttcccaaatggtgaagcacctctgcctccttccctttacacctgtggacctaccacactggggaactcctaggtgagtcccagagaaagcccaggtgaaagactatgagccagtcagaagggatcagggtagaacccaagttgggacaggcaggggaggcagtcccagtctttaggggggtcaggtaattcccctttacaagccaaatgaagaaaaaaagttctaagggcagcatatgactccataaaataaaggacataattgggagcgatatctaatttatctattgaatgcctcctacatactcttttatcacttacatggacagaatataattggtgtgctgtgcgccatcaatctcagggcctgggcttcctgttctggctacacctattactgtccgattatgacactgttaatccaagatcaatgacattttaaatgtgctacagttatgggcaattgctgacaataaaaacagtgacaaattgatgaaacttgggcagagatgatctggtgtcaaaaataaaccataaagaatctgatttccaaactgagagaggtgcctgggacaccagcttagtggggaaagacccagcgagaagagaacctatcctgcccacatgatcttggccactcaggaagccacctgctctggaaaactccctctaggctgacttgaaaggccccagcaggaagatggagaggtggtctttggttaaggcttgggttccctttagagagaatcgtcatcactgagactctgggaagtgtctgtgtatggctgccaaggtgggggccacacaaactcactgagatactggtggggggtctttcatgtcctgcccacactgaggaattagggcagactggttgagtcatagaatcacaattagccaatgttaaagctaaaagagaccttgagagtctctcttcatggagggtcaggctctgtcctccaaactgtccctcagcagagggacctggatcttccctaactctgcttcaacttgccccaggcattatttccccaggctaatccccttccccacctgttgcagggaactccaggccttcaacaagcagaactattttggcgtacattaaggtgggcctcctccagctccttttttttttttttttttttttttagatggagcctcgctctatcacccaggctggagtgcagtgacaaaatctccactcactgcaagctccgcctcccaggttcatgccattctcctgcctcggcctcctaagtagctgggactacaggaccctgccaccacacctggctaattttgtgtgtttttagtagagatggggtttctccatgttggtcaggctggtctcgaactcctgacctcaggtgatccacccaccttggcctcccaaagtgctgggattacaggtgtgggccaccatgcctagcctccagctccttatttttaatggattaccttaatttgtagtattcctttcatacatttttctcactttaataatcacaattttaaatatgaatactttagtagcattgctaatactactttacataataatactttagtagtatcgctaataccactattacaaggataactactattgggaagcatttattgtgcaactactatatgtaaactctgttccaggtgtttcatgggtattatttttcatccccacagcagccctgtgaggtgggtattgttcttcacattttagaagtgaggaaacaggcctagagttgtagtgatgtgcctaagatgacacagctgataagcagtggagcaagaaaggagcctgagatgtggctcaacattcatcttttttccattgcccctttcacagacctttatagtcccatttatagacggggctgagggcctccctaaagaatctatagctagtcaaaggcagagctagacctaagcctagcttttctgacccttgtcgtattagacctgcattgtatgtatttttttttttaaagactggtcaagtgcagtagtgagaagggagaaggagcagaacaaggagtttgatctgtaactgattgtgaacaatcagttgagataaggcactaccttcggaacaccccccacactctttccagttgcaccacaacagtcctttccccagatcaccaccactcactcagccagagtcttcagccttggcctctaagagtcagcagggggtcacagttggctttgaaaccaagcagacaggtgtttgaatccccactctgccaccttacagctgtgtggccttaggcaggtggttgtgagaatttaaatggcataagcatataaaagcatttggcgtagagtctggcacatagtagtgctccctaaatggtagtcattaaagatacaacctgggacagtggcagctagtttaacaaaccaccatactccgtagcacctctcacctgggtgcaagtgccccaggccactgcagtagctgcacgctgagggtgtccccggatatataagaagcctctccgagggccacagaggttttttgatggcagatggtttaaaatatcatttttatattaagttgtataaaatatactatgttataaaatgcaaagtttgcatcattttagagctaaaacttaaggccacaaaaagaatctgctattttcttattaataaaaaatcctatttttatataatgcaaataatgaagatgaagtaacctattatttaattaaacatgtctttaaaaaaaaaagaaataattggtccttgctaatggcccttcagggcaagcccccagactgctggggtcgaagtttaccctcctgcctctaatatcaaagggactttggcagaaaagtttgagaaaccctgtcaggaacaaagcctacacaaggaccaggaaatctgacttcttcattctttaaaagaacaaaacaaatagcaacattgttttttctaccttcctactgttttaccttcaagtttagcattaagaacatgaaatgttttgtttaaatttatgattcttatttctggttcctttctgtttaataattgctagctgaatcattaatcatcaaccaagtgaatggtcacactttatagaaggctacaaggtggaacacaagattagttggattcttaagaaagaaactaaaagctgcttgtgacttagatgctcttaagttttatgactgtggtgggaatttgagcatccaggccttgcttctgatgatcctctcgttccagtgccccagttctaatcctctgtgggtgccctcagtaggcacaaccttggggctgcccagggctcaaggcatccatgtttttaaagtgcccaacaatggcttttcattcatcagaaactccacaggacacccacctaactggggctctgatacctaattcagcagcacccaccaccaagtctttctaagttttatttttttaatattacatgcaatatatgttaattataaataaatgtaataattcaggtaggtgaaaaggagaaggagaaaaggcccaagaagtttccccactgaggaagaatcctgattagcgaggcaagtcacgtgacttttgggaatcttgttgaatctacacccatttaaagtggaaatctatatagcctgattctttgatggtttagagctctgctcagtttagagttcagggaggtggtatctacagggtgtattgctctgataaaaattagcagcctgctcaagttcaaggtatgaggggactgatcacagatttgtttgagaatcattacgttggccctttggtgactctagggattagatccagagtacaaggggcccacacttccaagggatcccaccacaccttcaaatagcaggctcatggaaaggggattccaagattctccccctccagctacggcattgctttacaatatttaacattccttcactaaagagcaagtctaaattgcaagtactcctaggacagggactagcttagatccatgacagttccctctctgagagaagggcgtgccttactccaccggaccaaacaaaactaaagtgacctctctgctccccccagagaggggcactggggatggtaaaagcatttctgtctctgaacccagggatgaagtagagaaatgccacttaaccatagccaggacccaaagaattgtgagaccaagctaccaaaggctcaagtgaggggctggaaagagtgacaaaaacagagaaggacagatctgtgagccaccgcacttcatttaggaagtcagtgctagggtaacaggaaggatcgggcgggctgtcaggagagtggaacgtgttagagaaagaacaaaactgagtggagacgcaagggaagagaccgtttataggtgaattagcagcagagggtgggtggtggctgtgcctggggcaggggtggtggggcgaggaggtgggggtggcagtgactttgagggagctcttgcagagggcagccttttaaggtgaagagccagagctctgggtcttaagagttgggaaagcaggttatatttcacatccttccctgaatagagaaattgaatttggtcaagaataggtcctaagaaacagctgtgagcaccccacttttccatcttgttgatgaatatggagtgggagcaaagttgagtgtgggcatctgacaaggtctttatgatcctagatgcacttactataccttcctcctcctcctctgccttggctaatgtgctgtgggtacccactgcacagagggctgtaagacactcattgtggctgatgcagaagctgggccctgccctcctggccttctgaggaaagtgattattgtttttgtcttgtttttcaactatccctttgcccccagcaggactgaacctttccactcttaccatctctgggtcccttcagatcttttgtagccttgaactacctgctacaagatttttttctgtcctaagaacggaagtccggtctgcttcctaacattaatcccttccacaccgcacagcctcgtttcctctagatcagagagatggcttctggattcttctttccctgcaatccagcttcttctcctggggccctcatactgcagactgggatcatcatccaggcttttgcactgggccaggaatttgggagtcatcctggatccgtctgcccctgtcaacctttctctgtcaacagatatttattgggcatcttcaacagccaggccctgttcatggtgctgaagaacagcatgtataaaacaaccctgccctcacagggcgatcaccagtgacctgtggtgtggagtctccttttacctctgtctcctccttcccattgtcaccatctttggtcctcctctgtcatctggaatactccacttggtaaccagcatgatcttataacgctagttttacccttgtcagcactttgccgaaaacctcaaataaagactttttaaaaaatgtgcgatggaaaactaaagttataaattatatcataaccattggacctctttttaaaatgcactgaagacttataatgttattcatggatatatatctatggtaaaaatagaaaaaatatatgatggtggtgcctctgaaagggaggggaatggtactggggaagggacaaagggaacttcaactttatctgtaatgacctctttattttgaaaactcaagagcaaaattgacaaaattttaacagtaacttaacaaaacctcaagtctggatagtgggttcaagagtgttactttatacggacaggcagtgactcatgcctataatcccagcactttgagaagccaagacaggaggatctcttgagcccagccatcctcccgccttggtctcttgaaatttgagactagcctgggcagcatagtgagaccctgtctctacaaaaaaaaaaaaaaaattaacagcaactcaggaggctgaggcagaaggattgcttgagtacgggaggtcaaggctgcagtgagctatgactgagccacttcactccaacctggatgataaagcaagactctgtctcaaaaaaaaaaatttaaaaaaaagtgttccctgtaatcccagaactttgggaggctgaggcaggtggatcacttgagctgaggagttcaagaccagcctggccaacatggcgaaaccctgtctctaccaaaaatacaaaaaattagccagatgtggtgggatcagtctgtagtcccagctactcaggaggctaaggcaggagaatcacctgaacccaggaagctcaggtggcagtgagccaagatctcaccactgaactctagcctgggcgaaagagtgagactccgtctcaaaaaaaaaaaaaaaaaaaaaaaaaggagtgttacattagttgtctatattgtagatacacttgtcaaaatttaagccataaaaccctcagtgtccctcactgttcccacccccttagcctggcatactgggtctttcacaagcttgtgtcaacctcctctacagactcatctttacactgagggacttgcagtttccaagtgctctggccttgcagcctttgctcatgctgttctcttctgaatgccctttcctgctttactactttgttcttgcccttctggattcagctcctgggaggccctgtggattgaagtcagatggctcaagtaggcagctggttaggacccaggagacagaaacgtgcctggggaggacaacactttcttgtcctggtttctattcagctgcaactagagaaacagatcacctgtttcttgttcaaaactaggatcagtgagaggagggtggaaagagtaagatcctccacagtgccctcccacctcccagcctccacccacatagcctagctccaaggcagaaacttcccagcagaaaaaggaaaactgataaactcattccttggtctggctctgttaggattatcatctggtttcccctgctggtgttggaagagctgtgttggtgtaggccagtgctatcctgtgactagagggaagaagctctgcctgggcctgatttggccacagctcctagtaatatgctgagaaggaacacaaactctaggcccaggtcaccctccccatgccatcccacacctgacttctgcgcaccttgtgagcagatcagatttggtgttgcttcttccacatcatcctcgcatcccctttcacagactcggatagatcccctcatgggaacctatggatctatggcatatctatagatataccaccccatggcaactgtcctttccccttcatagcatacatcaccctgaattatagctacctgtttatgtatgtgtcttctgcaccaggtggtactctctgatggggcagggattgagtctgtcttgttcacagttgcatctccagcacctgcaactctgcctcgctcagagtaagtgctcaatactttttgtttttgattgaatgatagaatgacgagtgaactctatttcccactagactgtgagcaccatgttgacagggaccatgccctgatcatctttgggtccttagggcctatatagtgcttgccacataggaggtgctcagtagacacttatcaatttgagtgaatggacttcagtttctccacttacaatctgagtaagaggaagatattctttgccctctctccctcattctccagccacattgggggttgtggttgatgccatgaggtcgttcctgccttattcaacttcatgtccaaatcttctaatggcaaaacacaacatggtgaccaagtctcagagtccaggcatccctcccatagcccatagccaagtatgggagaagggtgcttcagggtctctctccattcactttagtctccagcattagccaagatcccactgtctaccctgaattcttcctgctattgcacaaggcttctttcatcttactgtattgtcagggaaaatatagccaagattatctgttcctcaacctgaagtaaaatatagattctgcctaattttagaaccggtgttagccagctgtggtggctcacatctataatcccagcattgtaggaggccaaggcagcaggggaatcgcctgagtccaggagttcaagaccagctggagcaatatggcaaaaccccatctctacaaaaaaagcaaaaaaattagctgggtgtggtggcacacgcctgtagtcccagctactcaggaggctgaggcagaggatcatttgaacccgggaagtggaggttgcagtgagccaagatcgtgccactgcactccaacctgggtgacagagtacaatcctgtctcaaaataaaaataaagaataaaaccagtgtttccacatctggaactttcttttcaagtttatatcacctctccttccaaatcagatctcccctcctccaggaagtactccttgattaagccaaaaatgttttaattttcaccacttgtcctattactctgcatccccacagcacttgtagtttgtacttattccctatcctgtttaagtgtgtgttcatcatcctaaccatactgcataagcaggcactattttaagtaggcttcatagattatcagaaattgacaagaaaaaatacacaccgagaagaaagtagaagaggattttttcttttcttttctttttgctttatcatagaattccttgtcttggtgcttacaagctgtgtagcacaatgagaggagaatgtgatttctgcaaaacatttcaggaagcacaaagtatctgtaaatacccaggaataatgaccatgtattttatttgtattatttttctaattcctccactatatagtgtttgcccaaagtccttgatttaagcccttgagtgttggttggctgacttagctttggattgtggtccactgagatcgctggatctttttaagctttagagttatgccctgccatgtggatgcaggtggaggaaggacttctcagtgtgacccatgagaggagtggctttcctgggccccaggccccaggctgcatgtgtatgggagggaggaggagaagcaaggaaaggaggagagacagaagtatatactgagctggtagttgggggaagggttggcgggtggggagaaaggaagagaggagtctgggccaaggcagaggtgtctccctagggagtcctcagagcgggcagccggacgtcgctccatccttcccgccagatggatgggtctgctgcgcaggcacaagctgtcgggccaggccctgccaaggcagaacagtggcgcttctgtgcgcactgctccgatccgctccggaggatggggcccgcccgggaagccagggagtgatggagaaagcagatgtcccagaacaggagccgcggggtcacagaagcacgcctgcctcccgaaacaaggagccacaggatgaggtgggaggggaccgggaatcaacgcgggggagcgtttgggggaagtgttggtcgaaagaagagaggcagaaggacgcgcgctgaaggagcctggggatgaagagctcgatgatttggccacaagccccctcacctttaagaacaaagcttcctgccttcagttgcagagttttgtttcgcggtcagatgctcagagaccttccaacctgtcccccacccctcagccttgcccatctccacgggctcggagaccaccaccctccgcctccgcctggcctggcccggcccgcgagatccctgacgctccagttcggaatctgggatccgcaggctcccagatccgccgctggcccggctcccacccgcccgtcagccgcctccccctcagcgttaattaaaacttgcgagatggagaggctggcgcgggcggctccgtttaatttgcagcatctttcatgctgctgacgatcgtaaagggctttcatattgaaatatgggccattttcccagctccagccctcgccgcggctccccgcacccccacacccagccaccccgcgcttgatgaaagagcccctacaaatccattaaggagagataattgaaaactctggggtaatatttaagaccgtgtgccgacgcggggtggagggcctgactgcgcccgctttgcccgtcagtgctggtgcgtgccagtccctagcgctctaggcccaccaaggccccgcggacgcccagccaaggcccgccatcttagcggtgcctcctcactccctgcactcaaagggctggctctgcgctaatctggctctgctgaagacttgcctggagacctgagttccaaaaggagccacagggcatgctgtgtgacagatgcattagggccagcatgcacgggggccaaagcatcttgtcccactccttcagcttcggtttggtgcaccagcatcaggcactgctcaagcttctgagcacagcatcccctctgcctgcaaactttgccctccagcactttctacttggggaattgctgttcctctttcaaaaccaccccagttccaccccaagtaatggcgcagtggggtatggaacgtgggtgggagtatagacactccaagatcctggtgtgaccattgttgcagctgcatgatgaggacactatactgctctgttttcatatgtttttaatgttccacgacaaacatgtttagaaagcagctgaagcatcttcttttacgcctccctctcccataaatacagactacctgttatcttgtacattgatgttccttagcacatcgtgttgccattatctgtttaaagtctttctgcctactcagctgtgacatcttcaggacagggatcaggtctaaattcactccttagcccttgctccaggcccagtgcaaggcacataacatgcgctcagtaaacatcactgaataggctgctctctgggtacctagaagtctctagggcttaaggttaggatataagcacacggaaggagggtagggcaaagcatggaagaggggtgctgtctgtgaggctgggttggggtcatgtctctctcccacaatgactggcttcaggatgttcccagaatgggaaaagggtagaggaccctgttctgcactgtgatttaggaatccttaggtctctacctgggacttttggggatgtttctccacttcactccatttggcttactctcccaatcaggttagacacacacacacacacacacacaccaacaccacacaccttagacagggaaagagtgggaaagagggaagcagaagagattatttgaagacctacttgtgcaaaaggcatgagtagttcaggcattgccatggatacccagctaaccccctaccacagggcctttcctacttacccctgttgcacagtcttccccaacactgtgtccagcacccatacaggagttatactcacaggatggcactatcaaggaagagggggctgtattgactcagcccccccaaccgcacattggccctgaagccacagttgcaatgatgccctctctatggccagaatgagatccaaaccattccaaagttccatttccaaacaaggactcctcgttagaaccacaaaacatcagagctggaggcaaccaaaacagcactgtgtcccctcttagtatctatggggcaactaagacttagaaagggcctgtgatgtgccccaggtcacaaagccattggtaactgggcgggtagggtggctcacgcttgaaatcctagcactttgggcggccaaggcgggtggatcatttgatgtcaggagttcgagaccagcctggacaacgtggcgaaaccctgtctctactaaaaatacaaaaattagtgggcagtagtggagtgcgcctgtaatcccagctactcagggggctgaggcaggggaattgcttgagcctgggaggcagaggttgcagcgagttgagatcataccactgcactccagtctgggcgacagagtgcgaccctgtctcaggaaaaaaaaaaaaaaaaaaaagccattggtaacaaaaccagtgctagtgctagaatcccagcaagttagtggtggagctggaattagaatcccaatctcttgacccacttaaatatatacatttgatattcgaagtgcttttcacaaacattatctcatttaattctctctctctctcgataggatctcactctgtcacccaggctggagtgcagtgacatgatcatggcccactgcagtctcaagctcctgggctcaagcaatgctcccacatcagcctcaggcacatgccaccacacctggctaatttttgtatttttgtagagacagggtttcagcatgttgcctaggctggtcttgaactcctgggctcaagaaatcctcctacattggcctcccagagtgctgagattacaggcatgagccaccgtacctggtctcatttaattctcacaaacctatgagatagcgtcacaattcccatcgacagatgagaaaaatgaggctcagggagagccatgatttgtccagtgtcatacatgggtggaaaacagatccaggatttgaaccccagtttgactgggtccaattccagtgccctttccactcacttctccagtatctccccctaaaccccacccagccaagtcaggccagtttcccagacactcacccttcatccctggacatctccagccagaggtcttttttctccttagcccagcttcccccacccagggcaatgttctttgccccagatttggaggtgggggtgtggtagtccccaccgtggttctgggtacaggcctctatgaactgaagccatgcacagcctggcatcctgtgtgcagccctactcctgttcgtggccacggaggcctcagccataaatccccaggtcttggctcataaccattagcaagcgattgggttcatcaggacgcctttatgagactggagtcaaataaatggattgccggagatcaggaacaagggatctccttgtcttgccttgcttccaagttgctcccgcaacccagaggttggcagattctgtttgactcacagctgtaggtggaagtgggggcattgtcacagtgggataaagatgtacagtatcccctggtactccacacccatggaaggaaaagcgcttggagatgcacatcctcagatagcccacagtcattagggctggaggaacacacacacagaggcacatatacacactcagacccccatctctgattcaaatccactcttcagcaaccaaccccccaaccccacccacctcacatcctctgatgtcctcacactccattcctcctgtgaggtatttcctgaaacactgcttctcaaacaccactgtgcatacaaatgacctgggacgtggttaaaatacacattctgactcagtagatctggggtggcacctgagctctgttttctaaccagcttccaggtaaggccagggttgcttctccaaagattttaagcaatggtcctcccacattggaagggtaggggctttcaaaatgtaaaagagataggaatgtgcagtttggaaaagctcccctcccactcccatcccccaaatgctgctgtgcacacccaggtgactgaactgtttctagaatgctgttacctcactctttacatggctccctctcattcttcaaacctcagcccaagtgtcacttcctcagagaaactttctctgaccacccaatttattttattttactttattttattttattttattttatttttttgagccggagttttgctcttattgcccaggctggagtgcaatggcacgatctcggctcatggcaatctctgcctctcgggttcaagcgattctcctgcctcagcctctcaagtagctgggattacaggcatgtgccaccacgtctggctaatttttgtatttttagtagagacagggtttctccatgttggtgaggctggtctcaaactcctgacttcaggtgatccgcccgccccagccttccaaagtgctgggattacaggcatgagccactatgcctagctgaccacccaatttaaagggtccctgctccaccctgtctgtgattacccacttcacaacaggtctcaaaattgcatgtatctatttgctaacttgcttacttatttttttgtctgtttcactctctgaaatgtgtggtccttgagttcagggattatgcctgttccatttattcatgaattcttggcaaccggtgcctagtgcatagtacatactcagtaaatactgctggataggccagtcacagtggctcatgcctgtaatcccagcactttgggaggctgaggcaggcagatcatttgaagtcaggagttcgagaccagcctggcaaacgtggtgaaacctcgtctctactaaaaatacaaaaattagctgggcatggtggcacaagcctgtaatcccagctactctggaggctgaggcaggagaatcacttgaacctgggagacacaggttgcagtgatccaagactgccactgcactcccacctgggtgacagagggagcctctgtctcaagaaaaataaaaaataaaaataaaaataaaaaaataaaagaccatctgaaagagtatctgaatccagcactgaggccataggtaatctgagaaagtatcttggaggaaggaaaatgggaggaaaagaacattgtgtgaaggacttaagaaaggtgactcaagggaagtggggaggcaagggtatccagataagattggccccattggtcctgggttgatatgacagggttgaggaagggtcctggagggagagatcctgcgggtagcagcagatgccgcagggtctcggaaaccatggcaggcactaagaagatatgtgggcttccctccacctcatggacaaggaccttcatttattcattctttcctacacttgacaaattcttactgagatcttattaggcgccaggcactgtgctgggtgctgaatattcaggaatgagcacaatgggtctggtttctaccctcctagagattacagtccagtgggagagactgacagtaaacatattaatatgttacagttgggccaagtccacaaaggatagggtatgataacaggtatgatgggcggttccctagggagaagtttccctagggagtgacagtcacccagagtgctgatgggtggaggtcttccttgccagccccctgctaagctttcatcctggacattcctgcattcctctgcactgtccctttaagaggagcatctcttccctgagcaaaggtggttcgggcacacagcctgagcctgccaaggttgtgggccataaatcaatgctggcactcccttggcagtgggctctcctctgagctgcccagatggcaggcaagcctggggctccaggggcagccaggcactcaggaggggggaggtgggaaaggtggggacacagttgggccccaggctcctgatggcagctgcccacttctgtctaagggccctaggccagggaaaatgccaaagtccttctattctagtcccacgtaccttctgactcccaagtcagtctggcatggggctgttgggattattgttcccaccccagccagggaccagggcctcataggcatcctctgagaccaagggtcttggatgacctcttgggatcacagtctgctctaacattcaacctgaaagttctgcctgtggtttgaccttctttcctcttgctgtagctgaggtgtcttcttttaccctgcatgaaagatgaaagacagtagctccccatttagtgggggctttgggactgtgtgatatctccctctgccttcactttaagcctcccagaaaagcaggataaaaagatgcttcaaggtcagttggagagatggaaccctgccctcttgggggttgccatccctctgccaccctcacaggtgctgtgacagagggaacatatgttgctcctaccccagaggacagagacaacatcttaacagccacagccccacagagctgggctcagcaggccttgacagaactggaaaggcagcctctctcctgggcctgggcctggcctgagtctgggttgtgggcggaagggtagaagcaaagcctgtagacccctcccagaaaggaatcaataggctggactgctctccccacgctcactcccaaacagtagaacagtggaaaattcatgggttccagaacaatagagatttccttggatgtccttgtcctcagattctctgtgagaagtcagagtttacaagtccttagagattctttctcacacgctcatcatacagatgaggaaactgagatgcagagaagttcacccaggtctttttcaggttgtttttactacaccacatttgccacatgaacagaaactcccagagttatcactaagcaggatgtattagactctaaaggtagtagcatagatggaggttagataacaagtagaactttctcagaatagtaggtcacagaagaagatgagaagcaaagtaaagaaagtgcattctctaaaacagtagggtgggggtgggagggatggagccaaagaatcaggataaaattttgcaaaaagatagaaatatagagaacacaggaaagggagctggcatagagcccagagcaaggacaactggggtgtggagcttctggggttcttcattcaggacccctagatttcatctgtcccaggcttctgggtatcagcagtagtttaaagtcagaccttatctgggctgattctcttggctttctccttgttttcctgggatggcttatctggctgccagagtcatttgccttctctaatttgtgtttaaattaaagttcccacaaacagaggtttaatgtgctgttaccaagaactcccaggccccctgcagctctgggaagttgaaggggctggggagaagaggtcagtctgtgcgcatcccatcgaagctgatcccactggcattggacctggagtggataacccaaataagtgtctccgtccttgctgctccatccagaatggtgatgacaaggggcagggcagggaaaagcatgctcacaaagggcctggggccaacatgcttgttcaggggctcctgggtggctgttcatcctttttcaggatggtgaggagaaggcaggggaggtgggcaatgagaagagggcagggggtggaaaataaggagagagcaggaggctccattctttaacacttgtgtatggcgctcactgtgtgctagcactgttcctgggcacctcataactacaaattcaacctactacacaacctgtaaggcaggtgttattaacattagccccatttttatagatggggaaacagaggtatgcccagtatcacacagctactaagatgcagatacaaggagtcaagccagtgccgtttagctccagattcccagtgctatgttgacacttaagccaaaatttatctgtcaccctcccaatctcttgatcacaaggtgaggcttctctttgccagagcaactgagacaaagtgaaactcccatcctgctccccagaactttacctctcttggccgcagtcttctcatctgtaaaatgaggataagatactaggaggggttgagggtccgggaaggtttaatgagacagcttgtcagtgaccagcacagggtaggtccccagcagtggctgcttccttctctgtagtctaaccatgagccttcctgctgtgccttcctgcgctgcctcttaactttgctttcaaaggagctagcggcagtgatcctcgccccttaaagaaaaccctcaggagagcgttgttcctcattcatttgtccaaattctctctcttcctctgggaaaccctgaaaaagagggataatagagctgaactggagccccaacctgctctgtccccacctcctctgcacccaggtgagccagtcagggtggcaacagaaaataaatgacacattcgaaagggtttcactgaagggtttagtgatgtgacagtttctaaaggcatagatcagatgaagaaaactaataagggctagtgtggcaccaggatagaaatatctctaccaaagcccgatgccaactggggtcatgggacacaggagagaggccactcagcaaagctgtgaccatggaggaaccacaaccaccaccagagcttcaggcaggcaaaaaggggggctgacagggaatgggggaaacaaataccctgactcctctctccccgttctcagctgggacctctattggccgagagatcagggggcccaggtgacacagtctgcagaggtcagcctccctgggcagagcagcacagagaacacagtggggcaaacagaaaaccatccccatcccatcccacccgcgagtccctgctctgataccaaagccttctctctgctgctttattgccacctctatcactacctgcagccaaacagtgactgacagggaaagagagtcaagactccttcaacgcaaacactccagctcacaaggaaggtgggatccaggcagagggcagcttgagggaagagggctgtgtctgaagggcagcagggcagggactgcccactcccagcatggagagacaaagagaaggaccgcactgggggtgaggatgtcaaacggcgatagtaaatgactctctttcctcagcatatgatacaaatcactgtgcatcttccttcctcctcccctctctagaccgggagcccctgtggggaagggattttgtcttgttcacccttgacatctagcacagtgcctcttaggggcataatcagaatttattgaataaataagcaaatagatatgtaaacgaatgaacaaacccatttgcagctcatatgcacagccctgggccctggtcagggagcactgttgaatgaatgacatgcagcattcctacagtagttttatttcaatcggttccatcatttaccacttcaggtttcctttcagccactcagtcatgggccacacagcccacgtttgtctccacgctggccagaggctgtgctttgatagcacccactcaaatgtgcagtgacctcatcaggctcctcctgatggaggaataaggggagtagcaagtgacttcctttctcacagcagcctttctgtgagctctctattgagagaaatcttgatccatggcaaaccgtctgtggtattctcggctgtagcccttggcgggagatgggaggagggaatgacagtgccaaggaggcagctgaaggatcgtcaccctgggagccacagctctggcttccttttgccaatgggccataaagactgagggaggcaggtggaagcaggggcaccagactaacaaactagagtttcaagtgtagtccccatgcaaagcccacctggcgaagtggttagacacagatgctggggctgggctcaagatccctgttctaccacctgctggctgtacaaccttgggcaagatacttgattaccatgcctcagtttccacatcttaaaaaatgtgaataacagtaatgcctacttcacatggtggtgaaaaagtagatgagttaatagttatgagatacagccaggcctggtggcatgggcccatagtcctagctactcagaaggctgaggtggaaagattgcttgaacccaggagttcaagaccagcctgggtaacatagcaagaccgctccctcctttatttttttgagatggagtttcactcttgttgcccaggctggagtgcaatggcatgatctcagctcactgcaacctccacctcctgggttcaagtgattctcttgcctcagtctccggattccagggatgaaccaccacacccagctaatttttgtgttttgcatttttagtagagacagggtttcaccgtgttggtcaggctggcctcaaactcctgacctcaggtgatctgtccacctcagcctcccaaagtgctgggattacatgtgtgagccactgcgcctggctgcaagacacccatctctctaaaaatgaaagttttgaactatttaggagagtacatgatccatggtaagctctatataaattttgttacataaaattaaggttctagtcccataaaccttttctgtaataagctgctcagccttagatacctctcatatttgctgtgagaagtgaacaaatgcatgtgaaaactgtaatgtgtttataatttttattatttgtcatcaagatcatgtaagagacctgatttagtagagggtgaagggatgcaaaaggggctgtcagtcatcaacttttgattatctgccttgttaaggtccccttcttgtcaacatcatcagctctttggcttgttcaagtcttttgttgacaatatccaggcttctcatggtccctcccacacacaacgggcacacagcaagggctggaaggaaaaagcctttgaaagcaaaacgggtccttcccttccttagccttgaagcgggaataaccactagacagaaggctgtgagggagtactctggcactttcactgtggctgctttgcctttgggcaggaggggaaactgatcagctccctctgtggtaaggctgcaggaagagatattggcatttgttatgaagtgctaggaataaaaacacatacatggccgggtgcagtggctcacgcctgtggtcccagcactttgggagataggagcaggcggatcacaaggtcaagaatttgggaccaggctggccaacatggcgaaaccgtgtctctactaaaaatacaaaaattagccaggtgtggtggcggccacccgtaatcccagctactcaggaggctgaggcaggagaatcacttgaacccaggaggtggagtttgcattgagctgaaatcatgccattgcactccagcctgggcaacaagagcaaaactccatccccccaaaaaaacaaacaacaacaacaacaaaaaaaacagaaaacaaaaaacaacaacaaaaaaaacccatacacacatacttatcccagtgtccagagcaaatgttctgccacttgctgctatgggtgtgatttcagatagctactttaacctgagttttggtttttctcatcttcaaaatggaaatattgatgcctaattcaaagggtgaaaattaatgaactatagaaaccccttggtgtatgtctggtccaataaatggtagctcttattagctaacattttgtaatatctgcccactatctcctccaagggatggagaagtaatgctgacttccagactaggaaaggtagtggtagcagaaagtgatttacaactctgacttttttcacattttctttccagagcacatagtaagttcttgttggttcattcattcattgaacagtgtttagaagtttgaacaagcttgaacaacttgccatcattttgttcacttgtattcatcttactctcaccactagaactgcaaggtccatgagggcagaggcagtgtctgttgctgggtgagtgactggattgacctcaaagcatgtctgaagactgaaatggtccaggcaaggagatggaaactggaggcctggattctgggctcagtcatacctccaagaacataactttccctagaacctggagccttcacagaccttccttccactgtgaggcactggagaatcacttgagaccagactcagggaactcttccctcatgggaagacattcattcatccactccatgtctttgaagccccaagagaaggatctgaatcccctagtctgaagagtcagcaagtttccaacatagctatcatgataaaaagggagaattgataaaggagggagcagccccacctcagtaacaatagagggaggaaaattccagctagtacatgtacttaatatgaaagcagacatgtgccaagaccctgctttcatggatattaggtgtacccaaatataagaaacaccaattcttgcccacaggcctcactggatactatccaagatgtctagagaatgagaggaaagagagaataataatatccaaaaggtggaaacaacccaaatgttcaccaatagatgaacggataaacaaagtgtgatatacccatacaatggaatattagtcagccttgaaaaggaatgaagtactgataaatgctacaacatggatgaaccttgaaaacactatgctcaatgaaagaagctagtcacagtaggtctcttattatatgatgccattcatatgaaagtccagaatagggaaatctacagagactgaaagtacattagtgttgttaagggcaagaaggaatatggggggatagggaggtgatagctaaaggttacaagatttctttttgaggtgatgaaaatgttctaaaattaactatgatgatggtttgacacacctgtgaatatactaaaatcattgaattgtacatttcaaatggtgaattgtatgacacatgaattatacctcaagaaagttgttttttaaaaagacagcataaggggtagggggaagttgagatgaagcaggaaaactgtgatcagaaacaaagctcaggggctgtctagcctggctgccccaagtcgaagcctgcatttcatacaggcaatgttagggtagcccccaagccacgattcggaaagataaattgaccccagaaggtatagggctgggtcccttctcccctgacagctccctttctgtgtttttactggcacaagaaactctgtcatcttgtataaataggagaaatttatggcagttttccctcttcttctccctggtgggctactaggaaaggtccagggggaggagggagcctgaaattccaaaaatataaatgtggaaagactggagggtgtcgaggagtctctttgcctgccttggctctggccccagctctcctttccctttgcatgtttgaccatctgggtgatgcggagggcagagaactggtgcagcccattctctctgcaagcccaaaagagatgggtcccaaatctgatatccaacaggaggggcacaagggaaatcaaggaaataggcttggctgtcccatgaaattattggaggagacacagaccactgccctccttcctggatttggctatttttgtacttccttatttgttgaggcagcctgatacagtgggaagagaactcgtcctagatttagaaagattgacagagaaactaagtgtgtgaccttaagcaagtcatatcttctctccaggcctcacctgtaaaaagagggaggggactgaatttatcaggggttttcacatgagtttaactctggggtccttccttcaaataaaaccatatatagtgacccaacatgaacacgagtagtagcctgctgagcttcttgaaggtaagaatgggagtctcaggaccctgtggtgactggcgagaggcttgtccaagcacaagatgatctccatggcttttccagccctgtcctcaggagggatttgcccccatggtgaagaggctcagttctgcacacccagtgggcttgaaatccagctccaccccctcctgtgtgtccctcagcacataacttaccttccttgaacctgtttcctcgtgtataaactggaataatagtaacacgtatctcagaggattgtcacatagattacactaaataatgtgcatacagtccttcgcatactatctggcccaataaatatcattatagttattccgtgatctgatgtaatcagttttttgttttgagacagaatctcattttgtagtccagactggtgcacagtggcatgatctcagttcactgcaacctccgcctcctgggttcaagcaattatcctgtctcagcctgccaagtagctgggattacaggagtgtgccactgtgtccagctaatttttgtattttttagtagagatggggttttaccatgttggccagactggtctcgaactcctggcctcaagtgatccgcctgcctcagccccgcacagtgctgggattacaggcacgagccatcgcacctggcctgatataatctttttaatttgaaatatctggtgtgagaaggtgaattagaaaggatgacagcaaaactgctataacacaaaggccccaaaacacagtagcatatagaaaacagaagtttatttctctcttagtctgggaggaagcggttccagacagcaggcagctctgttcctcctagtcagtcagggacgtgtgttcctttcatacctttgctttgtcttctcttagggatatcttttcagttgcctggtcaaacctgtctcaggcacatctgcccagctcatgaaagagagaacacaaaggagaatttacccaatgccgtcaggctttgaggacatgctctcctcacatttccctgtgtctacacctggcaacaagacagctgggaaatggagtgtccagctgggtgtctctccaccctcgggcagcaaggaaagaagagattttagtggacaatgggcagtcttaatccagggctcaaacccacacctgagctgtcctcttcctcttctcttcccaaaggaagggaaataaagtctacagcccagaaaacaatgtgaccacccatcccctacccaatcaggtccctgccattcatcccaagatcagctgtttccggaaagtggcttggaagcctccgtccagaaagaccaccgttcggtccatcttcttcacatgggtggatgtgagaaaagtttctgtccccactgcctgcctgccactccctgtctcagtttcagctcatgctctagccctttgttcccagtcaccaagagtgactacaaatatgagggaacaggaggacctgaaacagtcatggaaattgagactgggacacagaagccaggctcagagacagcctaggtgagggttctcatgccaggaaatccagctactactgtgtaacctaaagcggggattaagctctcagaacttcaatgaactcttttggaaatagggataagaaacccacttgtcagggctgttgtgaacatcaaatgtgatcatgtatgtacctagtacatagtatgccttcaataaatggtaaggcaaacggaaggcaaatcaaattcatgtccattactctgacccagcctttgcataaattcttttttcttctccttccttgtcaatgcatggctccctccctcttctttatttcctatcctcattcccctaccatctgaaccctgatctggaatctcttttctcaggaaatcttccatgattgaaaaattcctgcttggccactttccactccaatactctatcttcacccatcttccatctaccccatggtcctggcccaagtttacacgtgtcccatccctcccttcaaaaagcatgcagcaatggaagggctttaagtttgtcatcaagcagatcagagttcagatgccaactctgccaagttctagctttagaactttgtcagatcacttcctctctttgaatctctgtcttcccaaccctctggtgaggtcaagtgtgtgtgggctggtacataaaggatatttaatctcctctgctctacccaacctcccccaactcacactcccaggactacctctctactaaagggagttattagaccaagaaagtaattctcccattaccagatccaacccaaccttgcccagggaaaaagaagtgactttgagtctatgggtcttggagggaccaccaacccaagagctagagcagaggaaagacttggatatcccagcttccaggtttataggctctctccccaagccctcatatgcagccccatttgcaggactagcttcagggataggagagaaagagttgatctgattccaatcttagcctgtaagtagtagctcacctatgcctctattttcaaccttcctagatcagaagagcaacaatatcaatgacaactaatgggtacatagtgtttcctatgggatggacattgttccaggctctttgtacatataactcatttaatcctgacagcagcctttgagctaggtactattaaccccgttttacagacaagaaaactaaagcacaaggggttaagtaacttgcctaggtcatacaactcacataaggcatgaccgagattcaaaaccaggccgtctagctccagaatccatcctgttaaccactctgccataaaaagagctaacatttactggcagtttctatgtgccaagcactgtggaaaacacatggcatgtatttcttctaattccaaataaccccctgagataagttctattattagtatccctgttttacaggtcaagaaactaaggcagagagaaaagttaagcaacttgccctgagtcacacagctagatattaatagtttcagaactcctagctgttttgcctcaaatcccacctccccacccctgctcaaagcccctccccttctaggtgggttgtttagttcctatcataagttcttcacaaatctgctttaccccccacagcctacaacccttgttctccaaaactcctgttgacctccgtccctttcccttcccactttctccctagtccctctgctccccacaaagtcccccaaaccattctgtctctctccctctgctccccccaaccctcctccacaactcctgctgaaacagatgaatttcaccaaaaaagaccatcagactttccccaagccgtcccccactgtgcctaatcgcacacccccaggggaggcaccacagtggctaagctggagagccagaaataaaatcctcattctacttccctgccccctcttcccatcactcatctgggaatccagggcgaagaagggagctaaagtgcagagcattcatttaatattaacaaattgaaatgaattcttttaatgccaattaacttggagcggccccttattaatagtaacttagattcatacttgggagaagcagggacgggggctgggccaaatgtgcccagaatgtcaatgtgactggggacctgaaagcggaggggtggcagttttgcttctgcccagttgggttctgtttccctgagagaaatggagtcactggaggcggatctctgggaaacacaaattactcttgtaagtttatttttgttacttcaaggaatctgaatagtttgaagccatgtcacaccattttaagagtttattttcacagtaatgctaaaaagaagaatttcctcagggctgggatttacttcaaactctctcctaagccaaaccttactgacaaaaggaacaagtccccaggccagctctctacccttctttgttcagagctagagccagggatcaatttgggcttcctcaatccctgccccttctaccttaacaaaaactaaaaggaagaatcaacactgtatgtctctctgagaagtctcccccaggaggtaaaagacccaaagggctgacccctaagctaacagcttacatttaaggaagaaaaacaatctgcctgcacttttcttagaatttaaggaaaaaatgagaatttaaaattcaatttcatgtatcagagttctccagaatacagccaagtggaaagaacttagtcccaaatgaaaaagttgaacagaaattctgctctcactcgttttgccagcttggaggtgagactggaggtgtcctgaactagaaccagagcataggttctgacccaagaaggacactgtctacttcccaggcatccctccttggctgggaggagaggggaggatgagtccgttggaagctgagaattgtggaagctggggatgggagttttgagatggaggaggcaggagcgtgaaggaggtcagggaaagacaagtaaatctactaaccattgcagtttataaaataaaaaccttaaaaatggtttaacatgcaaaaggttaaattttaaaaagaggtcaggttttaaagaaggtaaaatacctcaaatttaaacataataaaaatgaggaaaatacacaaaaatttcaagcaaattgttcttcagaagaggagaggttggaattaatcaaaagaccttttttacacacaccaccccaagagtttcccaaacaataaattcatttacaaaacaaaaagaggaatcaacacaaaacctcatccacatacagagaaaaataaattgtggtgattcggtaacagctgaaaaactagtgagggaggagaaaaatgaataaactctaaatccattaggtgatatttataaatagcaaaattggaggatggaatggagaaaggagttgcacttatcattaaagaagtaacacatgtgaaaacataaggtgtaactcatccccaaagaaaagtaaactctccataaagtagcaagtatagaaatttattgaaaaggaggaaagtaccactcaccccccccaatataagtgtattaatttgaattaaaattttctccaaatccgagataggttacacaaaagaatacaaaaagatttttttctttcaactaagaggaaaaacaaaatccgatttaaattcactaatgggacaggaagggaggctgtggtttgcaggtgctagtaaacggggtgaaggttgtgaagagtttgaggggtagaggaccagcttacctcgctttggagccgccgcggccaacaggagtgggcaaaggacgctgccagtgcctgagtgatacgggaaataaggaataggggattcgggtgcacctagacgaatgaggaggatggaaagactgggggtgcccatctcccttcctttgcccgcctccctccctccggtacccaggcctagagagttactgaaagttacaaattgcttccattattactcatcctgggcggcctggtcattggccagcccctggccacgtggtccctcgtagcaatcgatcgaatttctagtcgcaattctctgtccctcagctctggggagaaagtgggggctgtggcgtgggggctgaggtccagtttggggcggggtgggagaggagtccttgagtatcctgtccccgggccaaacccccaggagtccagtcttcaggacctccttgagccgacttccaccgatggagggggatcttcagggcacctgctgggttctcaggactcctcttcagatcctagtttggacccctctggattagaaaggatgggctcagcacatctggtgaggcaggcaggtcctcgctgcagcacagaatgatcccatggccctcaaagcgtggtgtcagctgaaagttcattgatccgtgagccctctgcctccctcctccgttgaaagagcagtggcgtgccccgcttttaaaagccctggggctcctgcaagcggacaccgctttccaggacatgtgcaaacagggatggtgcgaagcagaggtggagacaatgcgatcacgtgtggcactggcgtatcccacagcagatggtgtgaatgtgcgtcaccggaggcatatggggtgatggcgaaaccaacaatggtgtccaggcatgtgcccagtggaaacgggaaacaagtggcctttccctgagtgccaagggaactcaaagaagacctgggaacctggatggggcctgtgcctcagtccaagccacattttgaaatgcctgccagaggagcacagaggtttctgcaacattcaccccaccccgaagcctccaccgcccaggtagccctgatgcaaccttccctgcacccagccccaaacccatccccaggcccagcccagttcctttggtttcctgacattcattacagccaaaagattcaaggaatcagtccacctatgagtagaggagaggatatccctcatttgtgagacaggacttgcagaggaaatgggacaccacctgtcctagaagacaaggccagtcatgatcacctagcgcttattctaggcaatccacccacccatgaggtgaagcaaggagaccaaagaagcttccctgtctgagacacgcatggaagccaagtgttccaggcttatcagacctgcccaatccagcagaaacaggtttggagagagaaagagtcatgtcacgcatctccagaaagtgtctccctgatggactgggaagcgatcttcgtagaagttattagccagaccaagaggcaactaggcccctcagaaacaggggagacagagcaagagggaggacagagcagaggccagagcccaggcaggttacaggaccttgccactgccacgggcataaggggaggggtgtgaaatgtgtgacttgtccagagaggccagcattccagggacagggattgttgccgtctcccattcccggcttcctcctcagaattgtatcgtggtgtggcttcattgctcagagaagagccgtgcaggggtacaaccatcttcttggaggtgggtctgctcctctcctgccggacaatgagctgctgtggggttttgtcctgggctggagtgtggtcctcttgatcttagaaaagtggccgctcaggatggggatgagacttcgattgctccgggactgacgcgtctcctcacatgatcgaggacttcacaaacccaaagtggaaccgccgtgaaaatgacggacaaccggccaggggacccaggcagagacacagaaagaggctcaacaaagactggccgatatgcaaaaatttgcattttggtgaacagagcacattcgtccaaagatacacacacacacaggcatacacacacaaacacacacacacacagactgacagagagagggaaagaaacacacagagggtgagagacagagagagaagagagaacgggacacacacacacacacacacacacacacacacagtcctacagtggtggcacagaaacacacactccctggcaacccctgaggctaactaatagtggaaaatatgtatctaagaatacacttggaacagaaatgtgaaaaaccgaaagtaagaggtattatgaaggatcaaatataaaatgacccagtgctaaagaggcaacaaagaaaactgtagaagaaaatgacaagaggcattgtgccttaatgagtttgtgctactatatagaaaatacactaggctgggtaatttctgaagaacagaaatgtatttctcacagttccataggctagaagtccaagatcaaggtgccagcaggattggtgtctggtgagggcctggtctctgcatccaagatagtaccttgtgcactgtgtcttcaggaggagatgcactgtgtcctcacatggcagaaggcggaagggcaaaacaggggaagcccactccttccagttgtgtaaggatcctacacccatttgtgaagactctcccttcatgactgaatcactacctaaaagccctacttcctaatcctatgacattggtgattaattttagggggacacattcagagcatagcaccctatattcaatttcttaaaaattattttgttgttttgcttttctgtttttcaaatgacttaaagtgctcaaaattggattaatcataatccttggctcatagcacaccttggctcctatttcatccttgtctgtgcctgagcctctgtgtaaatgtatttgaacaatatggtaatcacttgtgaacttacaacacaaccaaagaactagggttctgaccctaacatctgctcctcctctgtccttttttctgattttccaccttcagcccgagggtaactaataccctgaatttatgtttaggattctcttcctttaaaaaaaaaaaaacattgtttgattgcatacatatgattaccctaaatgacatattatttagtttttaagggtataatttatttacccattctcctattaatttacccattctcctattaatgaacatttggcttatttccagatttttgctattatgaatggcattacatgagcatttttttttaatacttctggtacatatgggcaagagtttctccagggcctatggcagaggaattactttgccataacatatgagaatgctcaaatttataagataatccaaattgctttccaaagtggttgttctaatttaaactctcacctcctgtattagttcgagatgatcttgttgatccagtctctccatatatggtgatatggtttggctgtgtccacacccaaatcccaggttgaattctatctcccagaattcccacatgttaggggagggacccagggtgaggtaattgaaccacagaggccagtctttcctgtatgattctcatgatagtgaataagtctcatgagatctgatgggtttatcaggagtttctgctttggcttcctcctcattttctcttgctgctgccatgtaagaagtgccttttacctcctgccatgactctgaggcctcccccaccatgtgggactgtaaatccaattacagttctttttctttacacctctttttcttctcagacttgggtatgtctttatcagcagtgtgaaaacagactaatacagtaaattgataccagtggagtggggtgctcctgaaaagatacccaaaaatgtgcaagtgactttgaaacttggtaacaggcagagattggaacagtttggagggctcagaagaacaccggaaaatgtgggaaaatttggaacctcctagagacttgctgaatgactttgacaaaagtgctgatagtgttttgaacaataaggtccaggccgaggtggtctcagatggagatgaggaacttgttgtgaactggagcaaaggtaactctcgttatgttttagcaaagagaatggcagcattttgcccctgtcctagagatttgtggaacttttaacttgagaatgataatttagggtatctgctggaagaaatttctaagcagtaaagcattcaagaggtgacttgggtgatgttaaaggccttcggttttataaaggaagcagagcatacagttttggaaaatttgcagcctgacaatgtgatagagaagaaaatcccattttctgaggataaattcaagctgtctgcagaaatttgcataagtaacaagaagctgaatgttaatcccaaaaacaatggggaaaatgtctacaggacatgtcataggtcatcacagaagcccctcctatcacaagccgggggcctaggaggataaaatggatttctgggctgggccaggttcactgtgctgtgtgtagactagggctttgtatctctgtgtttcagcccctccagccatggctgaaaggggacaacatagaacccaggccatggccttgagagtgcaagcaccaagccttggcagcttccatgttgtgttcagcctgcacatgcatagaagtcaagaattgaggtttggaaacctccacctagatttcagaggatgtttgaaaacacctggatgtccaagcagaagtttgctgcaggggtggtgctctgatggagaacctctgctagggctgtgcagaagagaaatgtggggtcagagcccctatacagagtccctactggggcacttcctagtgcagctgtgaggagagggccactctcctccagaccccagaatggtagattcactgacagctttcaccatgagcctggaaaagctgtggacactcaacatcagcccatgaaaacagccaggaggtgggctataccctgcaaagccacaggggcagaactacccaaggctgtgggagcccacgtcttgcatcagcatgaccttgatgtgaaacatggagtcaaaggagatcattttggagctttaaaatttgactaccttgctggattttggacttgcgtggggcctgtaatccctttgttttggcaaatttctcccatttggaatggctgtatttactcaattacctgtacccccattgtatctaggaagtaactagcttgatttggattttacagggtcataggcagaagagacttgccttgtctcagatgagactggaaagtggacatttgggttaatactgaaatgatttaagactttgggggactgttgggaaggcatgatcggttttgaagtctgaggacatgagatttggaggggccaggagcagaataatatggtttgactatgtccctacccacatctcaacttgaattgtattgctcaggattcccatgtgttcggggagggaaccagggggaggtagttgaatctttagggccagtctttcccatgctattcttgtgatagtgaataaatctcacaagatctgatgggtttatcagtggtttcatcttttgcttcttttgcctccttctcatattctcttgccactgccatgtaagaagtgctgttcatccaccgccataactctgaggcctcctctgccatgtggaacccttaaaccaattaagcctctttttcttccctgtctcaggtaggtctttatcagcagtgtgaatatggactaatacatttcgtattgtcaaacttcttaatatttgtggagagaatagatgtgaagtatcttgtgcatttccctgattactaatgaggttgagaaaatttttatgttttgcaggctttctcttttgtgaaatccctattaatgtcttttcccaattttctgttgggttgctatttttaaaattaattcataggagctccttatacttagttgatatgatattaatcttttgtaggtttcagttactgcaaatatcttctctaatttatagtttatcttttcacttttttacttttattttttaatttctattttttgtttttgagacagagtctcgctctgtcattcaggctggagtgcagtggctcactgcaacctccacctctcgggttcagaccattctcgtgccttagcttcccaagtagctgggattacaggtgtctgccactaatacctggctaatttcttgtatttttagtagagatggggtttcaccatgttggccagcctggtctcaaactcctgatctcaggtgatgtactgttgggattacaggcttgagacactgtacccagcctatctttccactttttgatgtaaaaagttcttaattttgtgatagtcaaaatgtctactcttttttaatggttaaatggctttttgtgtctcattcacttacattttctactaaaagttttaaagtttttttctgacatgtaagtcttttgtccatctggaatttaatgtttgtatatagaatgaagtaggaatataatttcattttgtttcttatatcaataaccattatttttctattctatttattgaaaagtcctttctttccttgctgatctgccatgtcacctacatcacatatcgaagattaaatttgtggagatttgcttgggaactctattctgtttcactagtcagtgtatcagtgaggaccacactgtcttaattgctgtagctttataaaagtcctgatatttggcaggacaaatctttccttttcttcaatgtctttgatattattggccccttcccttttccatatatgtatatatacatatatatatggaaattatatatattatatatttatatgtgtgtgtatatatatatatatatatagagagagagagagagagagagagagagagagacaggcagaggtctcactttgttgcccaggcttgaggacagtggtgcaatgatagctcacttcagacttgaactcctgggctcaagaactcctcctacctcagcctcccaagtaactgggactctaaggcatgcaccaccatatccagctaattttttttaaaaattgttttttgcaatgatggggatcttgctatgctgcccaggctggtctcaaacttttggcctcaagcaatcctcccacctcaggctcccaaagtgctgggatcacaagagtgagccaccacacctggcttcattttccatattttaagaccatttttaaaaagttgctcaagactgcttttttctcttggtgttacttgcaacccccttacttagccttggaaatactgttagtgaagaaaatctaaagagtcaaaaaataaaatattctttcttttcttccaattgcaaaagagcagacaccctcctgaatcataaagctagttttgataaattggtgaactgagagcatacacagtattattaattctgttctaatttctgcttcactgtggagtgtcttcagagtcttaaaagattattgctatgaaatattcttatacatgtaacacaaaacctctacaattctgcagttgtatttggctgtcttacctaatactcagttgctttgcttcataatatttaaattgacatctctaatttccaaaaggcataaatactagtatagatttttagttaagccagaagaaagtagactttctttactaacatatcttacatgtaaaaatttaataaatctcccttcttcttttcttttgcatcataacaaccactgaaaatagtatttctatagcagttgggggtaaatggacaatgacttttgtggccagaggtgaatggcccaggggctcctgcactccaggtcccactgagcctgccacacagctgagggcatcagtatttccacacacctatagtgcatgctgtcccagaacacagatcagattctctcctatattcaaatggggagttgagagtattgtcattgtaattaaattaataaatacatatttatacactgttaaaatctggttggctttgtgtcccttcacaaaacaaattgcttaaatgaaaccacagagttaatataattgagtacatttgcttctatgagatgctcttttaagtggaattagaatctaatttgaaatgtcaattaaaagtttaaatattcaactcgattacattaaatttttgttttgttttgttttgagatggagtttagctcttgtcacccagactgaagtgcaatggcaaaatctcagctcactgcaagcaccttctcctgggttcaagcgattctcctgcttcaacttcccgagtagctgggattacaggtgtctgccaccacacctggttaatttttgtattttcagtagagatggggtttcaccatgttggctaggctggtcttgaactcctgacctcaggggatccacccacctcggcctcccaaactgctgggattttgggcatgagccaccatgctcggcctttttagattactttattttagttacttatttttatgactttattgttataaaaatgctaattttaaaaaatcaatcaatataacaaagaacacagaagatgatcaacaagcattcccacctctgtgatctagaaataactgtcatcaatccaaaagcttacacatgggggatcccttcacaccagttcacagtacaaagtaactccttgcttgtagaaaacattattactatcattattagttttgagatggaatttgactcttgtagcccagactggagtgcgatggtgtgatcttggctcactgcaacctctacctcccaggttcaaaggattctcctgccttagcctcccaagcagctgggattaccagcgcacaccacgatggcctgctaatgtttagtatttttgtagagacggggattcaccatgttggccaggctggtctcgaactcctgacctcaggtgatccacttgcctcaacctcccaaagtgttgggattacaggcaggagccaccacacccagactagaaaacattattcaatagcaaacattagcagtatgcttgggggttttaggattgattattttcaaatctctagaaaagctcaatgcattaccttaggctataatctcagggtagagtctcatctgttaatggggggctggtctaagggtccttccagctctcagtttcccatgttgaactgctccctgtcacccaccatcctcggtttttttagtttttacagagatgaggtttcactatattgcacaggctggtcttgaactgctggccttaagcaatcctcctgccttggcctcccaaagtgctggagttacagatgtgagcctctgtgctcagcccatccttggctgttcaagtgtagaggtaagtagtagatgccaagtttaccttcaggtcagaaggggcagatgccccagggcagagtcataaccctaaccaggcctcccactgcatgaagacattatgttctgaagcttaaacctggacaaaggtctgaccagtagcactgtgttcatgaatatcaggtcaaaaatttaaaactgggactatgcagaagaacctggtagatgtaggtgcagtccacagtccaatggtcagccttgataacaagccacctgtactttctttttatcatggagtccatgatgtaaaaattgatgacactttcttgcttctggtgtgcttcctttcttcttcattttccataagtagtttcctccatcccacctcccaacaggccacagtcaattcaggacattttaaccatgaaaatgagtctccataacacgaatttagaggccagacagagtggatcacgccagcaatcccagcattctgtgaggctgaagtgggggaatggcttgagcttaggagcttcagaccagcctgggcaacatggtgaaaccctgtctctaaaataaataaataaataaataaaaataagccatgtatggtggtgcatgctactagtcccagctactcaggaggctgaggtgggaggattgtggggccaaggaggtcaagtatggagtgggccaagatcatgccactgcaatgcagcctgggtaatggagtgagaccttatagcaagaaaaagaaaaagatttaaaggacaggctgactgtcttgttacaagccaatgctcatttgttattccataaatcctagggcacctcttaagaattatgctaaatctacactacccctgctctataaatggaacaacaacacttggatgatatcagagctgtttactgcatgggttactgagtattttaatctcactgttgagacctacagctcagaaaaaaagattcacttcaaatacttcagctttttgacaatgtacctggtgactaaagagttctaatggagatgtacagggaaacacatgctggtttcatgcctgccaacacaacatctattctgtagtccatggattgaggcatcattttgactttcaagtcttattatttgagaaatatattcgtccagggaacgaatctcctcacaacatacctaagaaagagatatatgtacagaaaacgaagcacagtaaaatatcacttcattactatcggagattttccccaaacacagagaaagctctacagagctgagcttaagccagaactctgttatttacatggtctaatgccaaaacaggccagagacccctttcacctacttctctttaatcccaaacccatgtctcgctttgatctaagaaagagccaaatgcccaggaggtgccagggtagagaaaagcagccagccagagagtggcctccatgccaggggagtgtgtctgagctttgttttatttttcttatttgtctgtagttgtgtgattggtagaagagagtagatatgaagtctactgacacaggattggtcctcaggcatgtcttatcaagcatttgggggaacagaagggttccacaaataagagagcaatgatcagactttcttctaaaaggagcagccacaagctaccttaactctccaacttgcccattaatcttcacctagagttaggaagatttcaccattatctgtggcccataaaagatccttaagcttgaccaaccacagaggtccatctccttgaggaggaagtgaaaggggtatggacagaagctgtgagctttctgtcctccgcaggcccccagctgtatcttctacttcttgtacaagattgtctccaaatgatgttttctggctgacaatgccacagaactgatccttatctcactatggaaatgaaagatttcgaagaatttgttgcctgaaatatggtgccctaatcacatattaataaagctgctatccagaaagaaggcagatttcaaaagaaaggctgttagcatcctcagggacctaaaaagtacatattgtagaacaatggtaaatagatcttggaatcaggtagactttaattcaaatcccagctatgccacttattaacttatgtgacatagggaaagcctctcaaatttagatttgcaaaatcagaataatataagtagccaacaaatagggtttaatggagttaataatgaaggtgattaagatgataaaattaaatagtgaatataaagtgcttagcatttaataaatttattgtatgatttcaaagcacatgcttttacctacagtgctataaagctgcttgcgatagtcaaagctaatagaagctcttgtcagagctaatagaagccttgtatatgtaattatttaagaattctgtaaatataaacaatagggtaggaatgagaaaatctttagaggaaatattcaagtatatttgatttctagcaaatccagatagacagttttggcaacaaccaagtcataatttgaagtcttgttataggagctagaattttattcaagggacaactgatttgattagattagatgctgtgcactgcactttgggatgtaatttgattttgatgaggttggagttcccacaatggggttagcatcctaataagaagagcagaagactagagccctcttctctcagccatgtgaagatacaacaagaacacctgcaaaccagtaagagggccttcaccagacactggctctgctggtccagattttaatcattgaattcccacaactgtgagaaacaagtatatgctgtttaagccactcagtctacagttgtttgtagcagcagcctgagcagacaaagacatagggctccttttattttcagaattcagtttagctgtaatcacctaccatcctgagatgctgtttcttccctcctcccttgaaatataagctctgggactatagcttcatggacaaattctgaagaatttgtctctgctcttgtgggatgctaacctaaccaaccaaagaatgtttgctcaatggaatgaaacatcttaatgcagctcaccagccaatatctgcagagcacacctcatgggttctggctggcttggatttctgagactacttcatcctactcatcagactgtggactcagattcagccaggaggcccagattctagcgtcagttttgcccttgggatacaaatgcacgtcctgcttcactgaacatgaaacctgaatatttggccattactctggcaattgtcctctctccctgtgccaattgccaatcaacccaactcccaggcagccttggcagttatgtctgcttggcctgctgtagcagccaatgacttagtaaaagtcagaacatagatctgctagctcccagtccaggatttccccataactcgtccatgtatatattaaacaactaggcttgcttttaaaattctttttcatttagccttttcttagaacttatcattttgagaatcctgacctgccaatattccataacctttctgaaagtgacaaagcaaatacgatgcatgcacactgctaactgcagctgatttcattttccatcatctataaagcacataaggtaatttctaaaccagcagtaagatctatttataaagaatgccgatttgttttctgcattttccaacacaaagcttcaatttatttccttaccataaaaaaacattactttttaaaacaatcatagttagtatattttataaatgttttaatttttgtaaagtccaacttgcaaattggagtgtaaatagctttcttaaaatggaaggaactgtgttagacccactatgctgattgatgattttactgtgcttcaaagcagacgatttcacagtcattgggtatataatgtaatgagtttttataaagcaattcatatcattaaaaatataattataataaataaaattatagggaaaaggaaatcttcattctgacaatgccaattttttaactaactcattgctaaaagattatgtttctacatgaaaaattttacacattctttctatgaaataaacctgataacaccttgaaaacttaatagttatgggaaaggaactactgtgatttattttagagaatgtcgtgttcttgatgttctcaagtgagcggtctcatgttattagaagggaaacagcagtaccttgtggacaaaaaaagaaagtgaatgaatttttaggacccggtgcagtggttcaggcctgtaatcccagcactttgggacacctgggcggagggtaacttgagcctaagagttcaagaccagcctggacaacacagtgacacgccgatctttaccaaaaattgaaaaattctctgggcttagtggctcataactcaggagccagctacttggaaggctgaggtgggaggattgcttaagcccagtaggtccaggctgcagtgagtgtgatcataccactgcattccagcctgggtgacacagcaagaccctatttcaaaaaaattatatttatgtagcactttctacaaggaatatagtatcatgtttgtatttaaatgacatcaggaccagcatggtggcttacacctgtaatctcagctcctcagatgacggaaggcaggaggatcacttgaggccaagagtcggaaaaccagcctgggcagcataatgaaacccccatttctacaaaaatgataatagtaatcaaaagctaggcgtgctggcacacacctgcagacctagctactgtggaggctgagtggaaggatcactttgagcccaggagtttgattgtattgtgtattgtgagctacgctcgagccactccactccagacaacacggcaagacccagtctctaaacaaaatacagggacatcagagcattatttatagagatttataaatgatcccaaaatgtcttcagggagataaatcatctaaatatagctatatcgactcttcctaaattccaaatttgggtgggaaaaataaatgagatagaagacttcttgaaatgtatcaagactcaggaagacaaaacaaaaactttcattaggcagtatcaagaatgttcattaatgctgtttctaatttatgatacggtcatctaaagaggaaatcccagcaacaagaggccaaaggaaagggaaaagaaatgaaaacaaggaccatactttctccacatccaacctcttttctaccacctctcagcaagacctcccacagccaatcactgctttctcttgcggacttaccctctactctatgaacacatgagccagagaaccctgagaagtccctgagtcccttccaggggctctgcaagggcaaaagtcttttcataaaaatacacaggttttgtttaccttttccactttcattctctcacaagtataattggagtttcccagctacctgacgtgggatgtcacaagaaattaaacatagaagcagaaaggagaaccaagtcttcttctattaaaccagacattaaagacatacctaaaaatataaaacaatgtcactgttctcaccaactttactgcttaaaaatgataattttaagtaaaaatgtgatttacgtaaacatataagtatattatttttttaatttctcagttttaatgtttaatatgataaatatagatagacataatccaaataaataaaagctctttggggtcctcaataactcttaaaaatgttaagtgttcctgaaaccaaaaagtttacggactgatgcgctaaagctcataccctttgatgtagcttccacccaggtcatttcttaaatacttgatcaaccatttcccatgtccctcaccctatccttgttgcaaaattccattttcctactgcagccctccctgtcatgagaaagttcccaggttgtagacatgatttactaaatctttcttaacagctttatcataataacatgacatatacaaattgtataaatttaaggtaacttaatgttttgatatttctatactttttgaaaggatcaccatgatcaagcaaattagcatattatctctacatatttaccattgtgtgtgtgttgacagtaattaatttatgatctagtcctttagcagaacacaagaatatgatacagtgtagttccatgttgtgcattatatctccagaaattattataacttgaacattgcacaatttaattaacatcaccccatttcccctccctgagctcctggcaaccactgtcctagtctccgtttttaagaatttgactgttgtagattccacatgtaagtaagatcatgaagtagttgtctctgtgtcttgcatttttgcttggcgcaatatcttccagctccatccatgttttcacaaatagaaggatttccttcttttttaaggttgtataatatttcattttatgtatacacatcacattttctttacccattcatctgttcctctgccaaaggacatttaggttattttcatattttggtcattgtgtgtcatgctgcaatgaacgggatgacagacacctctctaagactcttatgtcaatttcactggacatatatccaaaagtgaaattgttggattatgtggtagttctttttttttatttttgaaatcgttcccactctgtcatccagggtaaagtccagtggcaatatcatagctcattgcagccttgaactcctgggctcaagcgatcctcctacctcagcctcctgagtagctgggactacaggtgtacaacaccatatcgggctaattttaattttttttctgagatggggtcttgctatgttacctaggctggtctggagctcctggcctcctgccttggcttccccaaatcctgggattacaggtgtgagccatcacaccaggccagtgctattttccattttttttggaggaacctcgatactgttttctgtgttttactaatttgcattcccatcaatagtgtttaatggtttccttttctccacattcttaccaacacttatctcttctctttttgataatagccattttaacaggtgtgacatgatatctcattgtggttttgatttgcattactctgaagtttagagatgttgagcacattttcttatacctgttagccatttgaatttcttctttggagatgtatttatttaggttctttgccttaaaataaaattaggttatttataattttggaattgatgtgtgtgtgtccttcttattttttgaactccttataagagatatggtttacaaacattttccccatttcataggtggccttatcatttcactagttgttttccttgctgtgcagaagctttttagttcgatgtaattcatttatctattttgcctttgttgcctgtgcttttggaatcatatctaaacaaattattgccaagaccaatgtcaagaatgttttctcctgtcttcttccaggagttttgtggtttcagtgattacatttaaacgtttgatccactttgagttaatttttacataaggcgtgagctagggatccgatttcattctgttacatgtagacatccagctttcctaacaccatttggtcaagagcatatcctctgcctatagtgtctccttgtcaccttccagggtgatcaatggttgcaaatgtgtgggttatgcctaggttctctattttgtttcactggtttatgtgtctgtttttatgccagtaccacagtgtttttctttctacagctttgtaatttaatttgaaatcaggaactgtgatacctgtagctctgttcttgctcaaaatagcttcagccactcagggatttttgtgattctatatgaattttaggatcatttttttctatttctgtgagagtaccattgggattttgatatggattacattaaatgtgtagattgctttgagtaatatggacactttaataatacagtactaactctttcaatccatgggttgtctttcaatttactttggtttaaatttctgtcatcaatcttttataatttgtactgtttaagtctttcacttctttggtcagttagttccaaagtagtttatttgacactgttttttaaatttccctttcagacaattcattgttagtgtttagaaatagcaatgatttttgtatgtcaattgtgtatcctacaactttagtatatttattatatagtcagtccttcatatcaatgggttctgcaaccattaactcaatcaaccatgaacctaacttgtacatattttccatctgtggtgttttgaatccacagatgtggacccatggatacatagggtcaactgtacacaattttatatgagggagttgatcatcacagattttgttatctgagggggtcctgaaacaaatccccagcagatatgaaagactgactgtattatttctaaccattttctgtggagtctttagagttttaatgtataataatcctgtcttctgttaacagaggtaactatatccttcctttcaattttgatgccttttttttctcttgcctgattgctctggctaggacttccagtactatgttgaataggagtgatgagagtagacatccttgtcttgttccagatagtaaagaaaaagctttcagtttttccccattgattataatattagatataggtttttcatatacagcctttatagtgttgaggtaagtttcttgtatacttattttgttgagagttttatcatgaaagtatattgaattttgtcaaatgtgttttctgcatctattggaatgttatttttatcttttgttctgttaatgtggtatatcacattattaatttttacacattgaaacatccttgtatcccatacataaattccaattggtcatggtgtatgaccttttcaatgtgcttttgaattcagtttgctagtttgtattttattgagaatttttgcatctatattcattaaggatactggtctgtaattattttttattgtgttgtcttcgtctagcttttaagtcatggtaacatcggcctcatgaaatgagtttgagagtattctctcttctattttttctgaagagtttaagaagttttggtgttagttctttttgaatgtttggtagaagttgcccatgaaagcgtctgcacctgggcttttctttgttgggaaatttttgattactgattaaatctctttgcttgcttttggtctgttctatttcttttttgttccaccttggtagattgcatctttctaagaatttatccatttcttctaggttatccaatttattgtcatataattgcttaattgtcctttataatcatttgtattcctgcacatttgttatgatgtctccattttcatttctgattatatttacttgagtttctctttttttcttagtgtagctaagggtttgttatttttgtttgtatttccaaaaattcaactctagttttcttgatttttctattgttttttattttatagttattttatttatattctaatctttattatttacttcattatgctaactttgggtttagttagtttttctttttctaattgtttatttgcaaagttaggttgttcgagtgagatctttcttattttttaatgtaggtatttatcactgtaacatttccctcttagcacttcttttgctgcatcctgtaagttttgttgagttgtatgttcatttttgtttgtctcaagatatttttaaaattcccttttgatttcttcttttacccaatggttgttcaagagtgtgttgtttagtttctgcatttttgtaaatgtttctgttttctttgttattgaattctaattttattccattgtggtctgagaagatacttggcattatatcaaacttcttaaatttgtaggatgccttgtgacctaagatttgatctatctcagagaatattctgtgttcacttgagaagaatatatattctgctgctgttggatggaaagttctgtatatgtcagtgtttaatctactgtgttgttcaagtcagctgtttcctctttttttttattcctgcctagatgttctatccattattgaatttggggtactgtagttgcctactattattttagtgttactgatttctccccttatctttgttgatattaactttgtatatttaggtgttctaatgttgggtggatatatatttacaatcttcccattgaagtgaacttttatcattatataatgaccttcttagtctctagtggcagtttttgatttcaagtctattttttctgatctaaatatagatacccttgctcttttttggttaccatttgcatagagtatcttttcccatcccttcactttgagcctctatatatctttatatctaaattgactcccttataaatatgtactgatgagtatcttttatgcattgtgccactctatgtcttttaattagatagtttaatcctttcacatttaaagtcattgttgataggtaaggagtaacttgcattttgttaattgtttttcatatgttttgcagttctttttttttttttcctctcttgctgtcttcttagtttggttatttcttgtagtggtttggtttcatttatttttcttcacattttgtgtatctcctataagtttttaatttgtggttgcaaatttacatcttctataaaaagctgtcttaatgttatcagcttttttggaatcattttctttctcttccttcttcagatatatttgcaaatactctgttgttcaagacacgagtaaatagggctctggctagaaatttatcaatacaaaaaaaaagatcctctgagtcttttgataagttggaaaataatgatagactgtggtagaatgtcatgtatttcaagttctgtcatctatgttactctgcaatatattttctgtgtgtattagtcaatgttatatatttataaggtaaatccataaagcatacattctagaatgccctaacttaggtccttaagagatatgctccttatagccttcttggcactcctgaagtgttaaatatttccattgaagaaggttgcatatggtttctgagatgaagtctagacaggttaggattattttttgctccttttgcctacacagcacccactgtcccctccctttgttattagccattatctgataccctagatgaagccaccttctgtccttcagttttcgcgtgggggctgatttcacccccagtttcaggaataagcacaggacagctactaacaagtatgttgttcactcaaggaagaaacccagctaagggagaaaggggggttgaaatccagcctgcatgttcttctccaagccacatgcaccgatacaaggttgcatctaactggagaaaggggagccattttctaatacttgcaaagcactgtgtggacagtggaaaccctgtatgagctcgtgacacaggcctggccaatgaatagacttctaatcctggcacagatgaaactagagatggacatgaaatccaagcctcacacccaaagtcaatctctagtctcttattgaaactattagaagtgtttctgtttttgctttattctggggctatggaactaaggaaatgtaaactggaggagtgatgatggccacattgcagcacaaagggaaaacttgtctgagaataaaatcaatggggaaggaaaaagcaaggaagaggagaggagccaagtcctgagtccctgcgttcagccattctgaagctataccctggatttttccattatacgagtccacaaattaatatatattttttggcttagaccagtttgagtttgaattctattatttataaccaaaggagtcctaccatattatcttagccagattttcataaacacggtatacgttgatgaacaaacttcctaaatgtttcaagttcactccaaagagtgaggggaaaaaagaaagaagaggaagaaaatggttacttatcatccacagtagtcaagggagctgcagaagcatcaagcaaaagcagcagaagttagctttgtactcccacaaaccctgctctgaagtactccacctagtggcccacagaagaagctgcatttctaaaatctttaaaaagacagaaaaggaatcaccacttaccctgggaaccctaacaggggagaaggccatgtaggaatatgtcccattggtttgaggtcgataagtccattttcaaagctttagtaattccagaaacaagaacatatttattttgctttgatcacacaatgcctagttatattaaaagtaaggagacattcaataaataccttttatggaaataaaaacagacaatttaggagaaaaataagtatcaatgcattattttcaaaggtaaagaaaaaagaaattattctgaacacacaaaactatattatcaaatatcatggtaaattatcattatatactaggtcacttaataaatttccagagatgattggaaagagtttccacaatagattttgtttcaccccaggaagaagtttcacaaaaagttagttacttatctccgttgttactagtaccaaactaatcctatcattctgagtcaaattacaaataacgtccacacttttctccaatgagatcacaggagatgcctcagtggagtgtgttttaatgtaagggcataattggtttatatttttcactaaaaataaattctagacaacttaagcaaaacaggaattcaatgaaaggatattgaatagttcacaaaatcattgaagatgctgaagaagcaaggtaagaactgagggaaactcagcacagccaagttcattcgacggaaggagatcttgggatgccaccactaggatgttgtcatttgacacttgtcaccctgtagctgggctctgctgaacctaggcacttgctgccacattcctggacgtgcatctctgctcaatttctcagaatcatctctgattctttcaggtcttttgcatcatttcatcgggttccaagttctaataaagagacatcagttggctgggcctagatatgtgcccacacgtgggtggccaagaaactggaaaaaggatcatgcactccctttcagcttttgtaatggaaggtggggcctgtcctcatattttgcttggggttcaaaaaactaggaagggggttttgttgaaatgaaacccaaaactatagctatccatttacagcaccttatttgtacaggaagaaaccatgagacaaaatgtataaaagtgcatgggaggtctaaacatatgagggggtttctgaggacagaaagatcatacttgattggtgctgtggtttcactgtgcctcctccgagattcagcgttgataatttgatagtgttgaggtggtgcctacaggaagtgatgaggccatcaggactcctacctcaggaatgggtttaggagccctcatgaaagggctccatggagggagttcatccctcttgctctcctgccttccaccatgtgaggacacagtgttccttgtctctggaagatgcagcatcaagacaccatcttgaacggagagaacagcccttaccagacatcagacctgccaacgccttgatcttggacttcctagtctccagaactatgacagataaacgtccgcttttcataaattgcctagtctgtgttattttgttgtaagagcataaattgactaagacaattggtgattagaaaaagttttttgaagtggcatttgagaagggcttgatagataagatctctacaaatagaaatagagagatggtttcaaatcacccaggtgaaaggaataacatagccatgttcagtctgaatgcaaaatggagatggtaaaaagtacataggattccaccaccagtggcaggacagaattgtaatgtggcagcaatctgtaaatataatatttatcactcattcacatttatttagagtctaatgtgttctaggctcagaaattaagcaaagaaaacctagatatgcataagtccaagactttgcctttgtgacagtcaaaataatgaccccataaagatgttcttgtccgtggaatctgtgaccatattactttacatggggcaaaagggactttggagatgtgattaacccttgagttagggggattatccttgattatcttgggggccaatctaattacctgcgtctataaaatcagagaatctttcctagctacagtcagaatgtgatatgactacagaaccatggtcacagacatcccacattactggctttgaagatggagtgatggtcccatgatccaaagaatagggacagcatctaaaagtttgaaaaggaaatggattctctctagagcctccagaaagcaatacagccctgacaacaccttgacttaagcccagtaagaccacagtcagaggtttgccctacagaactatagggtcataagactttgatttaagccacaaagttgtggtaaattgttatggcagaaatagataattaattttaagaactttattatttggaagataggcagaccggaaaatccaaattataatataattcgattaaaacctatggagatttgggctaggtgttttagaaaagaattgagtattaacaagactaacagaagaaatgttctaaaataggtacacactaagtacatcacatttttctaatgatcacgttgatagagcaacttagaatccatggttttaacaaaccaacaggcttatatacatatatatgaaaatattatatatatatatatataaaatatatgatatatggaatagccccatgggcacgggcagccctgggtcaaagggcgacactgtactagcagcccacaccccaactcacccgcctaccctgagctgacttgtctgctaaatgctaaataaacctgtcaacctgtctggtttaacttagaagggcctggatgcaacaagcctgagggctgtgactgggggaaaagagagtacagatggagctcctcctccttctgtcactgcccaccaactgaaaaccaccaaatgaagtttgcttagattctcagcccacaccttgttcccaacaaaactcatacaatgctttggcccccactacaatctctggaacaaaatattctacggatctgctgtttgagctgcaacttatcttactaaattccaagaagcttatgtaaaagaaaacctccagataatacaggattttcaaggtgatcatcattgctacttttaactagaaattatccagtaaaagtattgtgaattgctttgtgactatggtgatttatttagtctttctgatccttggtttgattatctcaaatatatgagtatcaccaattttataaagttgctctaaaaattaaatgaaagaaaaataatcctccttctccatatattgaacacttacaaaattataggcattgtgtccaggtttttacatacttacctgatagaagtctcctaacagccctctcttttaaattacaagcattttgccatgatttttacatgtactttatggaagcctcgtaacaatcacatcttttatagatcagcaaactgaggctcagacgagttaaaaacacattcaccatcaaatcataacaagggatgcaactgggattcaaatctggttctctctgatgccaaaaattgtgcaatttaacgggaaccaagttacacccagaacatggagggatcaaaacatgtggattcccttttctgccccctcatgtgggaatttcaatagctttcactgcctcagagcaatcctaaactccctcccaggttgcttgcaatggcccgcttattcgtggggatgattaggaatctgcatttttggaccacaagcatctataaagagttgtgttgatcaagaaataaaattttctaggccataggttactgtgaattgtctaccttctctgcaaaaaataaaggggctattccatgtaaaaaaatcacaggatccactgaatctgtgcagagagacttagaactatactgcaggagcatcttactgacagctgcgcctgaagaccagccgaaacacacaaagcaagagcacctccaatgaccaggtgtggtggctcttgcctgtcatcccagcagtgtgggaggccaaggttggtgaatcacttgaggccaggggtttaagaccagcttgggcaacacagtgagaccttgtccctacaaaaaaaaaatcattttttattattagaatcaagaagagtacctctaaccccttgccgttgctttagggtagagagctctggtctagaactcaagatgtgaaactgtgagtcccagtgtagctacttaagtttaaatacaagagctgtcagacacttcttctacagcaacgaaatctgtagcatccattttgtactttaaaaacttagtttttggcaagcctctaggaagaagaagagggcccagaactgggcatatgggtagggaggggaaaagaaaccggatggatgaaacagggaaagacgaagtgatgaagacgccaggcagagccagtcctcatgcttggggcctgggcctaggaaaggaaataggtgaagaagggaggagccccaggctgtggatgtctctgggggaaacttggttcagcaacagccagaggagctcctgaagccaagaggtatctgtcgcctccctacctttgggcgtcttctggtcaccaatgtgctgcaggtcatggctccggaataaaattgagctcaagttgtgagagctccaacgccgtggagcctggcgctactcccacctccacttcgtggatctcagagctgcaggatggctctgcccaccgcaccctaagctggcctcgcttggggctggcattgggggacagcatgttctgggcatctctgctcctttctgctggtgcctgtgcctttgctggccacccactcatagatatcagagccacaggacggccccgcagaaaccctgcgctggccctgccgggggctggctttggcacatgcgaccggtcatcatggtccccatggggcacctctgctcttctcgaggcagcttgggccttctcttgcccccacgtctgcagagctgagcacctgccgcctctccccaggaaaggcaaccaaatgccaccaacttaagccacccactgaaggccaccaactaaaggccggttgccctgccaacgagatcgtgtcctgcttaggaagaaccaatcaggccttgagttccctccacgcgctgcccttccatttgtcacgtgggagtccaggcactggctcacaaagccgtgccccccagagaccccgccccacctttcatttattggtagctggtagcaactttcaggtttcctcactgtgaattatgaatatgaattatgatgaaattactgtatcctaatgtacctcatgcactatctgacagccatagtcccctcttcccccatggcctctgagttttttggaaactagaaagaagatacatttctgcaggtgctttcagaaaaaaacattgccacgatctaagtttactctgtgatgtcaagtcatatttcatatgtcatacatattcatatttatattcataattcaaaatgtacatattcaataaaattaacaggactaaaaaggaaattttctaaaatttatacactaagtatattatatttttctaatgatcactttgatagagcaaacttagaatctatggtttcaacaaatgaagaggcttatgcaagagaaaaccaccacctaacacaagattttcaatgtgatcatcattgctacttttcactagcaattatccagttaatatattgtgaactgctttgtgactatggtgatttatttaaacctactgatcctttgattatctcaaaaatatgaataataccaattttataaacttgttctaaaaattaaatgagagaaaaataatcctccttctctatatattgaaaacctacaaaattagtaacattgtgtccagatttttacacacttaccttattgaagcctcatcacaaccccgtcttttaaattacagggattattcccagatttttaaacacttaccttatgcaagtctcataacaatcccatcttttatagatgagcaaactgaggcgcagacgagttataaacgcattcaccatcaaatcacaatgagtgatggaactgggattcaaatccagttctctctgacaccaaagtggtgcaatgtaatgaagaccaacttatatccagcacatggagggatcaaaacatgtggattccctttctctactctcttacatgtgaatctcaatgggtttcactgcctcagaacagtcctaaattccctcccaggttgccttgcagaggatcccttcttttgggggacgattaggaatccgcatttttagaccacaggcatctataaagagttgtgttgatcaagaaataaaattgtctaggccatgagttcctgtgaattgtctagcttctctgaaaaaaataaatgggctattctctttattttttgttattccactattgacaatagcctagaatcaacctaaatgtccaaaaagacttggtttaatcctgaggattactaatgttttcactgtggtcattgtggtagattatattaccattctcccattatctggtcttcctactgcagtggccctatttcctagaagattatacatttctgtcctattgaaggaagggtcagattaagacatgtgacctgtttggccagtgaaatgcaggtagaagtggcatgtgtaacttgtaagcagaaaatttcctttttcaaggatctggtagccatccctttcaaatgtaatcctccagaaggataataccttatttcccagtctccaggagagagtaagagcctaatcttgctccaagttgtaaaaattaccttatatcataaagataaaagaaagtttatttttcctttgagaaaagacagttagcaaagacaggtggcctatgatcgccctcttaccctcactttcaaaaactccacggccctttgtatcaggggagctgagttcagactaggtctggcctctctcccgtattgcaatagcttgaataatatcttccttacttatttaactttttccagtacatttttttctttgactctttcctccgtctctaaaacttacattgaaattttagtaggattcaaggcagccaatatcgacccttgaatatacaaaagaacgctttaagattaaaaaacccatgttatcttccataagttatttctttggactattgccttattaaaagtttctagttcttatttttgcattgaaaaggagaatgatgatttttaaataagttcctactcacttttaatttctattatcacagttttattgcttttcatgacaatacattcttcgcatgcctcatagtaaccaaaaggcaaacatttttattagatacactaaaaataaaagaacaagaaacaaaaacacacagagaaaatcacttaactacaaaggaagacaacaaagggacaaaaaggtacaaaaattctaaaagacaccaagaaaacagtatatggcagtacaggtccttatctatcaataattaccttgaatgtacatagattaaattatccagtaagaagacagataatgggtaaatggattaaaaacaagacctaactatattctttctacaagagactcccatcacctgtaaatacacacataaattgaaagtgatcagatggaaaaatatattttatgacaatggaaatcaaaagaatgcagaagtagttatatttatatcaaataaaatagacttcaagtaaaaaaactgtaaagacagacaaacaaggccattatgtaataataaaggggtcagtagaacaagagaatacaataattgtaaatatataatgcactcaacattggagaacctaaatatataaagcaaacattaatagatctaaaaggagagacaaaaaactgtacaataatagtaagaaacctcgatatcccattttcagcaatgaacagatcattgagagagaatctcaacaaagaaacatttaaactgcactctagatcaaaagaacttaacagttatttacataacatttcatccaacaattgcataattcagtgtcttttcacctgcatatggaatattgtccatgatagatatgttagagcacaaaacaagtcttaactaatcaaaaaatcaaaccatatcatgtgttttttttgaccatatggaataaagctagacataaacaacaggaggaacttcagaaattgtgcaaatacatacaaattaagcaacatatccctaaacaaccaatgggtcaatgaaaaaaaatttaattttaaaacgtcttaagacaaataaaaatgaaatcagaacatatgaaaacttatgaaatacagcaaaacagttcttagagggaagtttatagcaatacattttgacatcaataaagaagaaagataatgaataaaacatctaacaatgtatttcaaggaactataaaatcaagaacaaactaagacccaaattagcaaaagaatataaagatgagagcacaaatatacaaaataaagacaaaaaatacaaacgactaattaaatgaaggaatcttttttgaaaacgtaaaattgacaaatgttttgtcagactaagaaaaaaagagaaaattcacataaaatcagagatgaaaaaggatatactatgatagactctagagaaatataaggaatagtgagtaagtactacaaacaattatacgccaataaattgaaaagcttagaagaaatacgtatgctctggacacatataacccatcaaaattgaagaaagaagtagaaaatgtgaacacaccaatgacaaataatgagatggaaggagcgatttaggctctcattcaaggaaaatccaaaagacttcacacagtagctcacatctgtaatctcacagtttaggagcccaaggcaggagaatcactagaggccaggagttcaagattagcctgggcaacacaacgagactccgtctctaaaaatacaaataaaaattccccaggtatagtggtgtgtacttgtactcaggagactgaggcaggaggatcacttaagaccaggagtttgaggctgcagtcagctatgactgcaccactgtatgccagcctcagtgatagagtgagactctgtctctaaaaaaatagaggaagaaagaaaagttcacgacttggtggtttttgctgacaaattctacaaaacatttaaaaaatttatacaaattatttacaaactatttcaaaaaaatgaaaaggagggaactcttccaaagtcattctatgaagacagcatttcctgattccaaaatgagacaagaacagcaaataaaagaaaactccaggccaatatcattgataaacatagatggaaacattcaaaaccagcagatctagcaatgataattcaaaagcacattaaaaagattattcaccataatcaagtggtatttacccggggaggtaaggatagtctaatacatgtaaatcaataaaatgtgatacatcacattaaacaaagaaggataaaaaacatataatcatttcaatagatgcagaaaaagcatttgacaaaattagacatccttttatgatcaaaccttttaacaaattagttataaaagaacataataaaataaagaccatatgtgataacccacaggcaacattatactgaatggtgaaaacttgaaagctttgcctctaggatctggaacaagacaaggatgttcactttaatcacttttttcaacatagtactggaagtcctagtcataacaattaggtaacagaaagaaataaaaggcatgcaaatggaaaaaaagtcaaattgtccctctttgtagatgacatgatcatatatgtaaaaaaccctaaatacaccactgagaatcagaaatagtaaatgaatacaataaggtttcaggatacaaaagctacataaaaaatcagtaacatctctatacaccaatagcagactatctgaaaaaggaatcaagaaaataattccacttaaaatagctattaaaaaaacaaaatacctaccagtaaattaagccacagaaagatgaaaataattaaacattgataaaagcaatttaaaaaattaaaataaatagaaagatatcccatgttcatggactagaagaattaatattgttgaaattaccatactactcaaatcaatctataaatccaatataatctctatcaaatttccaatttcattcttcacagatattaaaaaatatcttaaaatccatgtgaaactacaaaacaccccaaatagccaaataaatcttaagcaaaaagagcaatgctagaggtattacactatctaatttcaaaatatattacaaagctaccctaactaaaacagcatggtattggcataaaaacaggcatgtagaccagtggaacaaaaatagagagcccaggcataaatccacatatttacatgcaacttatttttgacaaaggtgcaaacattcaattgggaaagacagtcttttcaacaaatggtgctgggaaatgtgcatacccacatacaaaagaatgaaagtagacccctatctctcatcatatacaaaaatcaactcaaaataaattaaatatttaaatgtaagaccccaaactatgaaactagtagaagaaaacataagtgaaatgttatatgtcattgatctgggcaacgactttttagaaaagacatcaaaagacaggcacaacaaaagcaaaaataaacaaatgagattacaccaaataaaaacttctgcactgcataggaaacaatcatgacagtgaagagacaacctacaaaacaggagaaaatatctgcaaactattcacttcataaggggttaatatcccaaatttatagaaaactcaaacaactcaatagcaaaaatacaaataattggattagaaaagtcaagacagttgaatagacatttctccaaataagacaaaaaaatcgccaacaggtatatgaaaaaatgctcaccatcactaataatcagagaaatggaagtcaaatccacagtgagatatcatctcaccctgcttagaatgctttttatgaaaaagtcaaaaaataacaaatgctggcaaggatgtgaagaaagggcaatgttcatacactgttggtggaaatgtaaattagagcaattgttatggaaaacaataaaacttccaaaaacattaaaaatagacttatcacataatccagcaatcccactactgggtatatattcaaagaatattaaatcagtatgtcaaagagatttctggactctcatgtttattacagcactattcacaatagcctagaatcaacctaagtgtccatcaatgaatgaatggagaaagaaaatgtggcatatatgctgtatttggtcattcttgcattgcaagaataaagaaatacctgagattggataatttataagaaaagagacgtaattggctcctggtcccatgggctgtacagggagcataatgccaacatctgcttgactagtcaggaagcttgggaactcgttcactatcatgaggatagcaccaaaccatgagggatccacctccatgacccaaacaccccctaccagaccccatctctaacagtggggattacaatataacatgagatatgggtcaggacaaatatccaaactatatcatatgcacatttggccataataaacggtaaaatcatgtcacttgtgacaacacgaatgagcatagacgacattgtggtaagtgaaataagctaaccacggtaagacaaatatcacatgatctcatttatatgtgaaatctaaaaacactgatctaatagagagtagaagagtggttaccagactgggaaagatagggaggagaggttttaataatgtgtcaagtatcaaaataccacattgtaccccatcaacatgtgaaattatcatgtatccacttaataaaagaaaagaaaaaagaaaatggaagagtcaagatactgaggcactggaagagatagaagagaaggtgaattggcagtaaggaagagagagtctgaaagagcaggtcacagagtggaacattaaagtttataacattagaaatcaatttttaagttattgaaaagttaagtttatagtcatgaaagtgagtagctcaattgaagcgaaagtaaaagtcaatgaaagattaaattagaaaatatattgcttggcatttagtagttacttcagaaatactaataaatcttaagaaaattaagaacaccaaagcattcatagtggaccattatcataatacgaatttatgtggtaatattttattctttccagtgaagggagtaattcaacagccttgactacaggttagaaaatgatttctccaggtgtgacccactgaccacattcattgtatttgaattgcttgagcaatttgtttcaggagaaaatggaaagattttaagatggaccaacgaaattaccactgagtgtctttaatggaaacctcagccttgtctagaataacctgagttatctgtttctatggagtctctgtgccttttgttttctttgttatttgcaattctgttagttgtagattactgatagtaatgcaaatattcatgtttatagacaggcaaatgattgattttggtggaagtataattaattttcctttttccaccttccatcaagaagtcagttttgaacctatcaagcaaatttatttcagtgttccttagtgcctagatatgtgtggctcttttaattttccataaaactcagtataacatcttactggctccctcattaaacaaatgagttaaacaaaaatcttagacaagtgttcattttatatttgtaagtcataatttaacctattttaagcaattttcctttatcattcctaaaaatacagattcctatgccccatgctagacctattgaatcaaaatctcaggcctaaggcacaagaatttacattgttagtaagcttttcaagtgatttttaggcatactaaattgtattaaccattaccattctaattctttaaacttgaattattgtatttataattccatcttcatcaaagtaaacttttggttagcaaaaacggtagaaacccccttattcaatcagattgggaccagtaataaacagattaatcacaaatttaagttagatggaggaatcataagaagtattagatgtaagtccttaaaatttaactttaatttaaaagacatgtgtaaataaatttgccagaatttcgatgacaaggtcaaagccttgcacggattcagagtggagtttcttgtggaaactatgccaatgatatgttgtcattgatttcttgttcactttctgtgaagacaactggggtaaggcaatctgaaatcctagattacacaatttttcccatttgtttctagttgtcttgccaacagttaagctgacagcaactgtttgagtttctcatttttccaacacatttagtttatttctcagagaaacaatactactcttgttatactcattttctcagtttacgtaatatttatttatttatttatttatttatttatttatttatttatttattttgagacggagtctcgctctgtcacccaggctggagtgcagtagtgcgatctttgctcactgcaagctccgcctcccgggttcatgccattctcctgcctcaacctccccagaagctgggcgtacaggcacccgccaccacgcacagctaatttttttgtattttcagtagagacggggtttcaccgagttagccaggatggctcgatctcctgacctagtgatccgcccgtctcagcctctcaacatcatatttaattaaattgcataactacaagaacaagaacaaatggcgtaaacatatttaggaatgaacacagcttcctcttagaaaatatacaatttctgtgatggaaggagaaatgtacaggcattaaaagcagctcaaaggctttcagtttgcagtggacatcagtcaataagttgtacacgggtacaagaaagtgctgattgtaaatcagttaagtggaggtcagttaaggcagcatccactgtatcttaatttgtaaagttaatgttctaaaactgggttcacttttgctataaaggaccagaaaatgtggtcctaaatgaaaaaaaaaaggacctaaaatgaaaaatattttaggctttgcaaaccatacggtctctatagcaaccattcaactctaccattgtagcaggaaagcaccatagatccatggatgtgctccaataaaactttattaaaacaggcagctggtctgagggccatgtatatatcttgctgttttcatgcaattttctaagttagtagttccctgcctttttaacaatcaaggattacttttaatcctctcctctgattttatgtttcaaaagccttaagaaaaaccctaaaaatatatttattttgtaattttgggggggttcttattttactaataagtaatcaatgatatataaaggctacccattatgtcagtatgaaataatcaacattattaactctaatgacttagttctggatagaaataagaagtattcaactatatgtatataacttaaaacctgtatagttttttctggtgtaaatatataacttttcgagattcttcaagtattaaatacaacttttgggaatcctcacacctggctccctatgatgacatttaagaattccttaggattctgggaatcttagaatgaaagtcactgctctgtaggaatgaatgaatgaatgaataagaaagggaaggaagaagaaagagcatgtctactaaatgtaaattaatcatcaaggaacgtttattttattaataaatttgtcaactttaggttgccaaatctaacaagagaccaacatggcattcatggtgatcacacctctagtcaaattttattttagttcattgactatactattaatatcctgaaatactcaaaaattctgtcttaattctgtgaataattcacttattaatcaccctatacttaatgaacggaatggtgttggaataaagataattacagggctaaaagggttttctctagaggcaggttataggatttttttgtctgactggaataaaacaaaattaatcaatattttctgcaaccagtggcttttgacttagtcatctattaatatctatcaatcactataacctcagtcctgtttcctccattcttctttttgctatcataaaaactggtccatttttttcctgttagatctatatgtttctcctcttttcttttcatccaaataactggtcatcaacttagtagagatagtgcaattgatccgaaccctacagaactcagtgtttcaatgtacataacttacataactgtcaagctgaaatcactctcaaatttttttaattcaaaattttaatttcatttaatcatatttatttattcattaatttattttgaaaataattttaacttgtattttacattcaggggtacgtgtgccagtttgttacatgggtatatctcatattgctgagttttggggtatgaatgatcccatcatccagatgctgatttggtatggtttgactctgtgtccccacaaaaatctcatgttgaattgtaattcccaatgtagggggaatgacctggtgggaggtgattagctcatgagggcagatttcccccttgctgttcttagatggtaagtgagttctcatgagatctgatggtttaaacatatggcacatcccccctggctcacttgctctcctgccaccatggtagaacgtgccttgcttcccacttcaccttctgccatgattataagtttcctgaagcctcccagccatgcttcctgtacagcctgtggaactgtgagtcagttaaacctcttttctttataaattacccagcctcaggtagttctatatagcagtgtgagaacagattaatacatgagcatagtacccaatagttagtttgtcaaaccttgccttcctccttctcccctctagtagtcctggtgtttattctgtccatctttatgtccatgagtacccagtgtttagctcccacttataagtgagatcatgtggtatttcgttttgtattcctgcattaatttacttaggataatggccttcagctgcatccatgttgcttcaaaggacatgattttgttatttttatggctgcatagtattccatggtgtgtgaaatggtttggaaggtggcccctataaatctcatggtgaaatgtaatcctcagtgttggaggtggggcctggtaggaggtgtttgggtcatgggggtggatctctcatggcctgatgctgtccttgtgatagtgaattctttcaagatctggttgtttaagggtgtgtggtacttacccccactcccattctctcttgctactgctctggccatgtgatgtacttactccctcttggccttccatcatgagtaaaagctccctggagactacacaggcaccatgcagatgctgtcaccatgcttcctgtacagcctgcagagctatgagccaattaaacctcttttccttataaattacccagtctcaggtatttcttcatagcaatgcaagaatggcctaataatactaatgtggatgtaccacattttattgatccaatccactgttgatgggcacctaggctgactccatgtctttgctattgtgaatagtgctgcgatgaacatgcaagtgcgtatgtgtttttggtagaataactgactttctttgggtcatataccagtaatggaattattggcttgaaaggaatttctattttaaattatctgagaaatttccaaactgctttcaacagtggttgaactaatttacattcgctccaattatgtgtaaatattcccttttctccacagcctcccaagatctgttgttttttgattttttaatagtagctattctgactggtgtaggatggtatctcattttggttttgatctgcatttctctgatgattagtgatgttaagcctaatctttgctaccagaaaactgggaaaacacagtgtcgcttgtcaaaataaattgttttactttgctttaaaaataatcaatttagtagtatatttcttccagaaaaattaagaagtaaacatttagaaatgtacagtaccttgctgttaagtcttcgcacaagtataccaatcgaacataaaggccactttaaactttcatttgaaatgaaagacaatttttaagaggttaagggctagtaatttgttaaagtcctgaagttaagttagctgaagtaaatataaagactttcctttaattaaagccttttaaatgaacactttaaagcatagttggtttctccctcaaatcttgtccaaagacactgtttacaactcagtatatcaaaggtttcagacatgattatgaagctccctcaacttacaatgtgctatttgcaaccttagttgctatcattctggcttttctaccttttggcaacaataagcacacccttcccatttctcccccaccctgacttacccctctttgcatttaatgtataatttttctcagaatgttcttacacatctttaactgtaaatatgacaaaagcacacagtatagtacatgtgccacatgtataaatgttgtatctattcatacaattttccttttaaaaaagaaatattttattttcaaaaagcaaagactctaggaatcttttctagctgccagtcataaaaacataaatttctggttagattccaaaatttgcctgaccataagaaacacttgtggtacttgtcaaacacatgtattctgagtcccatccgtgatctcctgaatcagaatcagcaggtgagaagcctgggaatacacattttaaacaaacgtccacagtgattatgattagtcaagcttgaaaaaaatttcactaggatctttatgactgaataacctcacaaacataggaaagttactggagaaaaatacgagcagaatttcagaattctgcctttgctgaaagtgtttgttccctcctcctctactcatcaagacctgactgcttatgtaactcccccaaaccaccaacacctgggaggagttgaaaatgattttaatgaagaagaaaagctgatgtttaatttcaaaactgacggtgacaatagaagggagaggcatgaatttatcttgattctaacacgaagcattgtatttcagtcaacaaacgaaattggtttcatttttattttttgtaagttttcgccaaactctatgcatatatagaggctgggcaagaaagaaatccagaaatatggcatatgccatcccttatttatttccccatgcgaccagccaacagcttcttcacctagtccctgcttcaagctgactttgtgtctacttctctatcggaaatggagcttccctaaagactgcctcaatgtcagttacccagaggccttttttccatcttgtgctcctaaacttctatgatattaaatgatattaccctttctggaaattctccttagctttgattttataattttactctaactgtttaattccttcttttatagcctttcttttctctatccctttactgcagacatgttgtacggctttgttcttgaccttctgatctctccacattcattccctcagagcatgtatccattttcttggtgtcggccttcctgactatctgattattaccatcatataacgatgttggtgatgagcatagctaacatatcctaggcattttccatgtaggttataataagcactctatataatttgtaccatttaattcttcaaccctaaatgatactattacgaaccacattgtatgagatgaggaaactgagattttcatcaaaaccatggaaagccaacgtgaggagcccctgtgtgtctcctttgttaatgcctctgggcatcatggcatgtggattgccctagaatggggattaggaagcgcagcactgtgaaaacaccagaaaatacgttatgatagcgggtaaggacgctcatctccgcacattgagatggttttatttctgagtcaggtttgaaatgagccaatcctgactccatggtgccaccagggatcacgaatttaataagatctttgtggatgcttggaacccaactggtctctgttttctactttagggaaagagccacagcttgagtggggtggttttggtgtcacatacgctatcaataatacccaccgttttggtgtcacatgtgcgattaataatacccaccgctgcagagggatcaccgtggactactcctcgtttcatcccatgctcttgcgatggatccctctcacctgtttaatgatttcattcaaattcttcagcgaccgcaggaccccgatttgccttctctatcctggttcccatcactctgctttacaggcctggcctgctcgcggctcctcacaccagcactgcgcatctccctccacgcctctgccctgtttcctccatcagacaggactagcttcctccatctctatcgggcaaaagcctgcccagcgttcaagaccctcctcagatgccgcctccaggattaggcttcttcctgacccctgagcctgtaacacgcgccaccataactctccacctccgcccacattcccacagcactcgcgacatccgcgggcctcaacatgtctcttcattccattttagggtatttcctgtttgtttcctgcacacacagtcgcgcgaggcacagccctgagtgacctgcgcgggagtggcccgcgcttcaagatgcgccgccgcaggccggggagggcagcctgagccgcttcccgcccccgcggggaccgtcgccagcccgcatctctagcgagaggaggttccacagcgcgcccggcagccccgccaccgtcagcacctgcgcctcgggcgggctttccccacctctgggaggcacgaatcctcaggggctcctcgagagggcgccagggagcagatgcatgcggacacctttcggccctctgcagccgccgtagctcctccctcacgccccgccccccccccccctcccggcagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctggtgggtctgcgttagtctgatcttgtagttcattataataacttcctttattagggattattcttttctccattgtctcttcctggaaaaattattgattaatttttttctaagctaatatgtagagtgaaaccgggatgaatcacacagtggttgaggtgtatatgggctttgatagggatatgggttggaacctgcactctgtcatttactaattttgtaatttgtggcaaattggttaatatgtctgaacttccatttactcattaagagatcaagtatctttgaacctccgtttacacatttaaacttttagaccattttttatacctttagaatactgtgaggattaaatgagagaacatacatgcagtaaataaattaagccaaatgtgaggaggaggtcgtagtggtaatttattagctctttaggagaaaaatacctgtgcattcatatccccgcttcttttttaactggcagatttgcctgaggttgactgtacatacaaatattgagcatttcctcctggcctccgtgataaacaggggttttgatattgttaggcgagatggaaagaaagtatcaaggagtgagctgaagccactgcccttgagaaccctctcgaggagtctggcctcatgaagatgccagaataagtggcaggtatatcctgaatgaatgtgagatttttactatgtgaaatgcctgtgaggagtggtgagttatcttctgaaaactttatgatgaaaatgcagacaagagtgtcttaagattatcgtaataatcataattaatgcttatatagcactttcaatgcgccaagaaattgttgtaggcactttgcacattaactttcttcaaattgctcttgggtttttatttttttattgcgatgtaattcataattataaaattcacccttttgtacagtcagtggtttttattatatattcaagaggttcaccactgtctagttgctcagcattttcatcatctcagaaggaaatctcttcctaaccattaaagcagtcacatcccatcttccccctctcctagtccttggcaaccactagtctgctatctatgtgaaattgcctattctgaatatttcctaagaaatcatgcaacatgtggccttttgtatctggcttctttcacttataacattcttgaggtccatcagttttgtagcacttgttcctttttatggctgcgtagtagtccattgtatggatgtaatattttgttcatccattcatcagttgatgaacatttagattgtttcccctttttgactattgtgactaatactagtgtgaatattcttatgtaagtatttttgtgggtgtatgttttcatttcccttgggtatacatacttaggagtaaaattgctgggtcatatggtaactctttaactttttgaggaacgccaaactgtttcctgtagatgctgcaccattttacatttccaccagcaatgtgtgaagatacatattacctcttaatcctcacaatagccttaagagttaagttgttatcctaattttttaagtggggaaactgactcacagagagattcagtaccttttcccaaaatcacagagctaagaagtgacagaatcaggatttaaaatctggcagtgtggctctacaatctgctttgaactttaacataatatgtacaaagcctgaagcaaattctcagtactgtatttaagagggcatagcaatgtaagtcttcctaaatcaataatttataaatgaaacaacttaaaagacttccaagtttcaatcttacgatattgatttatcacacaaatcaatatacttaaactcatctatataaattatgtcctgtagtaagaagaaaaagagcaaagataagaagagaaaaagagaagatgaagaaacccagcttgatacgttggtgagtcagttttcagtgctttattctgaaaaaagttaacatttcttgagatctcattgaaaatattttcctagttagaaatttatgatgtattcatatttgtcttaaagtgcttaaatattacctacagttgcaaattccatttattctttagcacagtagatgctactgatgcctttacttcattatcagaacagagcacaggagagaagaattacaactctctgacttagtaggcaccattagactgcttaataatagctggagattctgatacataattttaaaggcttaatgtaaatgttattcaaccaaatatattttacaagctattttctttgaacatgtatacattttagttgtagaagtcagttgtctcttaaacaaagtatcttcataggaaaaatcattattttgtgaactctgaaatgaatgaaaattttaaatacaatatcagggtagcctgtaaatgatactggaaataaactgacccaaacacacttaaccagcctgttttccgtttagctgtttccatactttttttttctcttttaaaacttggcaagttgcattttgaatcttcataaattatggtagcttaaaaaatatataaaatatggaatggtgtaaagctaatgttctggaagaatcattgcttttgaaatggcaaatcaacaattctaaaattagggtaaatatctagggtagatatgtagatgtggaattgctgtgtcaaaggataggtgaatgtttaactatataagaaactgtcaaaatttttcaaaagtggttgcgctattttatcctccttttcagtttcttaatggtggtttttggatggacagcttttttcttttttttttttttgagatggagtctggctctgtcacccaggctggagggcagtggcgcgatctcggttcactgcaagctccacctcccaggttcacgccattctcctgccttagcttcccaagtagctgggactacaggcacctgccaccacgcccagctaattttttgtgtttttagtagtgacagggtttcaccatgttagccaggatggtcagaagcttttaatgtttataaagctttgtttattttttttcttttatggttactgccttatctctttgatctaagagatctttgcttaccccaaagtctggaaaatattctacattgtcttttagaggcatcatagttttagtttttacattaaatctgtcattaatctcaaattaatttttggcatggtgtgagtttggttccaagatttccttttttttttttttttaacatcttgatagccatttgtgccagcgccactggtgtttcctttttccattaatccagttttgtatcttcataaaaagtcaattaactttctatgtattggtctatttctggactctgttctatcgattttctgtttttcttttggcatatttatcttgattgttataatttcatgaagtcttgagatcaggtagtgtgtgtcctccaactttgtacttactattagtttattgatttcttcagtgaagcctgttggattttctcggagaattgtattgagtccagagcatttgggggagaatcaacatcttaatattgggcctcaatatttcataattttcaatgtagcagtcttgcatgcgtgtttaaaaatttattcttaagtattttataattttacactactatcagtagaacttttgaacttgattttccagttgtttgttgtcagtatgtagatatacaattgatttttgtatagtgactttgtagtctgataagtctgtttcacttattacttctagtggtttgtttatatagaaaactaagaaatttgcaattatgtttcctgtgactatcgttttacttctttctttctaatccttatgtcttgtcttgctttttattggtttattatactgtccaggacttccatagtgttgaacagaagtcacgagaatgggcataattgcattgtttccaagcttaggcagaaagctttcagtagtccaccatatggtatgatgtctgtatgatctgcagagaaaacctttatcaaaatgaggacattccttttaaactttgtttcttggcagtttttatcataacgatgtttaatgctgtcaaatgtctctttctgtatctgttgagatgattatacaaatttcttcattctgccaatgaattacattggtttcattttcaacttttaaactaactttacatccctgagataaaccccacttggttgtggtgtgttgtcctttgggatattgctagatttgatttctaggtgtttttttttcttttcttttttttttttttttaagatttctatattggtgttgatgggagatattggactttgtatccttttcttgtaatgtctttatttgattttggtgtcaaggttttattgggtgtcataaaattagatgggaagtgctgtctccttccctgtttttggaaatagctgtgtaagatcggtatgatttcttctttacatgtttgataggatttaccagtgaaatcatctgaacctagagggttttatttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttttactgtctgtagaatctaatctgtattgcagtctcttcatattggtaatttgtgttttttctgttttttcctggatcagtcagtctagctggaggtttatcaattctttataagatcacttattttagatcattaatgatcttttagtacaggggtattcaatcttttagcttccctgggccacaatggaaggagaagaattgttttgggccacacatagaatacactaacgataagctgatgagtcaaaaaaaaaaaaaaggaaaaaaatctcataatgtttcaagaaagtttatgaatttgtgttgggctgcattcaaacctggcctgggccacatgcagccctcaggatggacaagcctgtttcagtattacttattttctatttttttcattttttatttcatttattttcagtctttattttcctccctttaacttattttcagtttactttgctcttgttttattgcttcttaagaagagagttagatctcttcattccacattagttttagttatagtcaacacattttgctttcattttcattccattcaaaatatcatctagttttccttgtgagttttcttttcatggacacttgagttatttaaaagtgtattgttttttaatttctactacatagagatattataagtatgttattgttgctgatttctaattcatttatagtatagttggagaacatactttcttagtgaatttccatgtacacttgacaagaatgtgtattctgcagatgttggttcagggttttttttttttttggagatgaagtcgctctctgttgcccagcaggctggagtgcagtggcacaatctcggctcactgcagcctccgcctcccaggttcaagtgattctcctgcctcagcctctggaggagctggaattacaggcacctgccaccatgcctggctaattttttttatatttttaatagagacggagtttcaccacgttggccaagctggtctcaaactcctgacctcaggcgatccacccgcctcggcctcccaaagtgttgggattacgggcgtgagccgtggcgcccagtggttcagtgttctttagatgtcagttagatcaactggtggagcttgtggctatgcacatcttctgtgtccttactgattttttactcatcctacaatgtattgagagttatgttaaaatctccagctctacttgagcagtttttgcttaaagtattttgaagctgtcatgtgtacacacttaggattgttaagtcttccttataaattcagtctttcattttcataacattttaacctttatttctgttaaatgtcttgatgcctagttaaattatttgaccacccttttgctcctgtcaagcctgggcctttgttagtttgtgcttatttattagatttttacctgcagacttagacagtgactcttactctaggagatgttcatcctcatgggcctcagccatatgttctaggtatacttgatgagttctctccactctgctatgtcccaaatttgtgtgatctctggcatctccagtcagccctcagaagtgccagccactctgcagaggccttgtggagcctgcctgctgtatgcactccccccagcccttggccccagacctgcagagaacttttgcattctcttttgaggcctcacctgtatgtagttccctcttctccagtaccttattctataaactccaaacatgttagcactgcaagactctcagcttagtgacagtgacattgcctcatttttggaggtctctacctctctctgtgtggtcaagaaactgccattgggcagaaaacagaagtgtgtgtgagatttgcctcctgtgttttcctgttctcaaatatcacagtcctgttctgcctgtgttccaatccctgaaaagagttttctcaaatattctatccagtttcagttttctcattggtcatggtgggagggcaagtccatcttggctggaagaggaagtccttcttcatctttttctctttgtccttccaccttcttttgcattgtggattttctaaacttgccgtataagtaagcatgtgcctatttgtgaagggaaagaaaaaacccttttaattttttaaagctgttctgttggttcctcacaaggatctgaagggattggtaaataggatgaaagaaattctgtctttcacatggagaataccatgtgtgacattaataaaaatgagcatgtctgtaagcaaagagtttcactgagctctgctagattcagaagctattgaacttacaacatcgtagtttgcaaaacacagatttgatttactcaggaactgaagctaagtaagctatgtgttaatagaaagtctgtgaagggtacttagactacagtaagattggggaagaaaattccatttccaaatctaagatatatcattcctttttgccaagcacataatgaaggtagagatttaagggggcccttagcacagaagcactgggttagtcagaaggtgacgtgagctgtcacacagccttgattctagaatgagggtgccctggtagtatcttatcagccatgacactggtacatcgggccagtttttttttttttttttttttttttgagacaggctcttgctttgttgctcaggctggagtgcagtgacgtgatcatggctcattgcaccctcgaccttgtaggctcaagcaattctctcacctcggactcccgagtagctgggaccacagtcttataccaccatacccagctaatttcttaatttttttgtagagatgggggtctccttttgttgcctaggctgatcttgaactcctgggcttaagtgattctcctgcttccacctctcaaagtgctgggttacaggcatgccagatatatggaagcattctcaactatgtgaaaatatgtgaaaagctttgttatgcattgtgagacaacacagtgggaatatttcatcatctgcctaaggtttaaaaggaaataactttaagcatgtgtctaaatagcaagtaatgttttagagcggattctcttaaattcagcttgggcgtctgcagcatatacacagcttgagctgtaacctgacatagagacaggcaacttcagtgcccactgttcctaggatccacggctttttcacacctaaaacccctgagtggcactgttaagtattatgttatgttactttagtcattaaacgtataagcatacctccaaaggttgaatgtaggccacttgcagaaagtaggcagaatgctcacatttaattcttgatgatactgtgtttagctttcttattctttgaaatatcattgagaagaaatactggcatctgctcaaagtaatttctttttcagttgacaatattataagtaatgttattgtatcatttccctacttggacagagtgtgaaaattttgaggattgtctgccacaaatttcttcttcatttgcaaaacattcatgagatattatatttaaatgattttatttaatattaagtgtacttggtgaaggtggcatagaaaatacaaaataaaactaatttaaaaatattaactattacatttataagaaagacttgctaatcataacactgttcataatgattctgaataaagcattatttcttttactgaaaacaattgtagctataactcaatcatctaaattgtcattagttttatttctttctaatcgcctctagctgaaattttaattttgattaattttctttttctccattggtttcgtgtgtgtgtggaggtaaaatatacagaatgtagaatttgttagtttttctatttttacgtttacacttcagtggcatttaaatacatgcaccattttaccttcccaccagcgttgcacaaggtttcagtttctccacatcctgcccaacatttgtttttctggttttcttggtttctgttttttgtttgttttgataatagcattctaatgggtgtgaagtggtattgcattatggttttgatttatatttccctaatgactagtgatgttgagcatcttttccagtgcttattggccatttgtatatcatctttggagcaatgtccgtgtatatcctttgcccagttttgaattgtatttgtctttttggagttctctatatagtctggatattaactccttatcatgtatgtagtttacaaatattttctccattctctgggttgccttttactgtgttgacagtggttcttgatgcacaaaactttttaattctgatgaagtccagtttgtctatgttttcttttgttgcctgtgcctttgatgttctatataagaaatcattgccaaattcattgtcgtgaagcttttcccattttcttctaaaagttttctaactttagctcttacgtttaggtctttggtctattttagttactttttgtatttggtgttagataagggtccaacttcattttagctgaaattttatatattttaaaattgattatgaaaagcatgaaatgtttagttgaatagaaaattttgtgcagtggaattaactgaatctttaaaacctttttattatggaaatatccaaactaatccatacatagaagaatataatgagtcccccatgtgcccaggccccagcattaattatcaatattttgccaatctcgtttcatttacatacacacccccacacacattttttcctagaaaattctaagtaaaatcacagatattatgtcattttacccataagtacataaatgtacatttcttaacttggtatgtctttctctcatcacctgttttgtcctttacttttatgcattatactatgtcattatcagaccttgtaaaattaacaagaattccttaatatttcatatccagttaatgattgactcatttctactctagttaaagtacaatttaggaggaggtttgaggatattttttaacattaagatataaacttttataacaactgctaaaataattgttgctaaagtctaacatttctattggcaaattggaaattagtatacatagacatagattctgctcattttgctttcaatctaaaatcgtagttaagattactggccgggcgcggtggctcacatctgtaatcccagcactttgggaggcagaggcaggtggatcacgagatcaggagttcaagaccagcctggccaatgtggtgaaactccgtctctactaaaaatacaaaaaaaattattcgggcatggtggcaggctcttgtaaccccagctactctggaagctgaggcagagaattgtttaaatccaggaggtggaggtcgcagtgagccaagatcgcgtcactgcactccagcctgggcgacagagcgagactccgtctcaaaaaaaaaaaaaagattactatgctagaaagtcttcctgagagacatttttaagaagtattatgataggcattgcctctggaaagcaggcatgaatagatggctagggtctatcatgagagagaccgttctccatatatcactttgtaccttcacatgttgccttttgttttgttttggtctttttttgaaacaggaccttgctctgtcactcaggctatagtgcagtggcgtgatcatagctcactataaccttgaactcctgggctcaagtgatcctctttcacagctccccgagtagctgggattacaggcatgcacccccatgcctggctgtatgttgctattttgtattttaaaaacctaatcctgactgtgctggtagttgcatgaatctgtgtacacacatgcgaacaagtacatgtaaaactggtgaaatctgaataagcttcatggattatatcaatgtcagtttcctgattctaacaatgtatgatacttatgcaagatgtcatcattgagacaaagtaagtaaaggatatgtgagatcttcatattatttcttacaactgcaagataaaaggtttttaaaactaagttataataacaactctgtgtcaaaactaaaatataaagttgaaatatcaattttattttttaggaatctggtgaacagtaacaaactttggtgaaatttcaggaaccatagccattgaaatggatgagggaacctatatacatgcactcgacaatggtctttttaccctgggagctccacacaaagaaggtttgtgtctggaagggaagatcctgccacaagtgtagattttaggacattcattcacttaggccaaactctaactagtatcaaacattttccaaaggaatgtaaccattgcatttgactcttccattttttttaattccttaatatttaccagccattggcaagtccctctttctaatataagcatttgaaaacattccgtatagttccagaagagtatctttggaaatctaaacaatatgaataattaaaatagtaagtggaaagaaaaaagaaaacctatttcagtcaaacatgtttgaatttcttttttattcagacttattaccaaaactaacctgggtgcatttaacaatttgaagtttcctcgttttctttagcccattagaggaagcactaatgagatacgaagtaattagaagataaaaagcagtatcatttggtcagcaaggccatccattgaataaatgaaagcatttagcttttttaaataagtgcttacttatgactgtattttaaaacataaagagaagctatctctaaagttattaaataagcattatatcaccctgtcttactcagtgtataaaattagcactgtagttaaaagaaggtaaaatagatcttgattccaaagatacagtattacagtgacatcagtatatctgaatattcttacatttaattgcagaagaaaatagccacattttttaaagcaaaataatgtctttatatttatagcaaatgtcaaatttattttcaaatgttttttctccaatattgatgagggccctagtcctccagagcagtttatggctgtcaaattatctgattccaggtgagcttatgttgtaatataattagtaaccagttattttaaaaatttaattgtattcattaaaaattttagtgtctgtcttaaggccatggtaattttgatataaaaaatgaaatagcttttttgaaaagtagattttgtgatctacttttagtggatttcctatcaatatataatgctaggctggaaaaaagatatgtaaattaaaaaatgaagattaataatttcacacaccaagtaagatagattaaaaaataaatcaaatagtacaaaacctggttcactgttgctatgatatttaaactcactgtttggaagtctaaagacaaacaggaagactaaaaaaagggacattgttgaaaccagcagagaatgttacagcatcataacaaccaaaagaatatttttactcactatttttacagtcattttataaagtaaccttttttattctcaccttgtgcagaaatatagaatgattctttgggtaaaagatactgaaagtgaatttacatactttagtaattggttacatcaacatgataatgatttctgttatataatcattaacgtataaaggagtaaaagtcaattatggcatccgaggagattcttagtaaggtaaaagaaatcataattttaaaaaatcacattaagatgattatttctatactttctttgaaattctgataagtagggtgaaagacagaataaaagcagaggaagaaaaattcaatagttttaaactgctttacaattataaacaaaaaaagattatacagaaaattaactgacaaatgaggaaaatatttgcaacaatcttaataggcagtgagttcttactcttcatatgtatcttgtatagaattcatagcactgaagaccccagtagagaaattgtgaacaatcagatctgaatagaaaaatggacaagggacattaccagataatctaaaagctagaaaggaaaagaaaaacaattgttattctagttaactactaaaatgcaaattaataggatactgttttttttccatatcaggttttcaagtatttttttagagtcataatgtttaaaaaaaatccatgatacaaaacatactctattaatttgaggtaagaatgtaaatggaagcagcattttctggaaaacagtttgatgacataaagttttagtaatttattattgaaggttataactaaagaggtataattgaagaatgatgaattttgaaaatatttgttatgtaatatataaggtacaatgtttatattaaaaaagcaaaataaaaaactaaatttaaaactttactgtccaatatggcaacaactagtcacatgtagcttttttttttttgaaggcacagagtctctgtcacccaggctggagggcagtggtgtgatcatagctcactataacctcaaatttctgggctcaagcactcctcctgcgtcagcctcccaagtagctggtattacatgtgcacaccaccatgcccagctaactttttaaattttttgtaaagatggggtctcactatgttgtccaggctgatcttgaacttcttgcctcaagcaattctcccattgccttcccaaagcacagaggttacaggagtgagtcaccactcagccacatgcatcttttgaacacttggaatatgtccagtctgaaactttagatatgtacacacccacacacatacacatgtcctgttttgatgtcctataattaattttctctccgtttttaacttttatctatcttattaatgtacagaatcgccctgaaatctggctatggaaaatatcttggtataaattcagatgaacttgttgggcattcagatgcaattggaccaagagaacaatgggaaccagtctttcaaaatgtaagtgctgttattgtttataaaaacttcctgtcagtttaacagaaagtctgtaacagtcaatcataatatatttaaaaagaaaaagtaggatgcaatagtataatacattaaattggaataaaccactaagaacatagagccttaaagagatctcaaaatatagtgcaacaaaaatagcattagtacttttgtccacaattatttctgtatacccttagtgcctagatatggatctcatttccattgaagaaccagtcaattttaggtcacagagtaggaaaacagaatagttcctaagtatcttctttttagcagaaatcatggatgttttcagaaacattacaggccgtaagcgaacagtggagctagctaagaccaagttgtgacaatttgcgtataaaatataaataataatagttcattgaagtaaattatctctaaaagactttcagttcataagcttaaaatagtgtacgaaaagatagttttaatataagaagaaaaaagttaatgtactaattctttattttattaagtagacagttgtagtatatggatgttttgttaaatctttgttgatacagaatacataatttcctttttctgtttgtgtgagaagtaaagattgaacaaaaatatgtgagtgctaaactgtctttaaaaagtagataactatatcaaaaacagtaaggaccagtgggcaccacgcagaacaagcaaatagaagataagctcagcctttgagtagcagctttggtagtatacaataatgaactgaaaataggaactcagcagtgttttctaagatgacagattaaacaaacatcccaccagaaagaggtaatcacttagactaatttcctcatcccctaggataaaatcttaagtcagtgacttgaaaactattttgacccaatccattgagaaatgcatttttacattgccagcccagcacaaacatatgtataactggagcaagagttgtacttaacaatacatacttatccatgtgttatgcaccttgatattttgtattctcttttaccccttcctctgtgtgtctgtgtgtattcctttcccccccaacccacccaataccgttcaggaaacattacattgatttcattacctgctaatgtgttgcaacccctttgagatgatcctactagttatgatgagatgcttctaataaaagttacaccagtagaaaatgccaatatttcataaggccaggatgatcgcttagatagtactaataatacaacactttaggaaagttcatttcattttatttttaggaaggacactaagtttcaaaaatttaaatttaaatgaaagagggtcttaaaactgtattgcgaaaaggactcagctgaataatctgtggcacaggtttaaatcgccttggaccacaccgccatgttccagggctcaccaggagccatccagatgagagaccacccagcccttgtgacttgactaagaaattaaatccatgttatcagcacatttttaactggatgtgatataaggttaacatattttgtaatcattgtatttataaatattttgtctaaatgttatggtattccaagttttccaaaagaatcaaccaaatacaagttataaataaacgttatatttgttacgggagttaagctaaccaaatttataacccagatttaaatacacaagaaaatcaggttttacagttttgtttaatagaaaccagtgtaatacatcaaacattaaacaactaaaaatgtatatgaatatttattttcacacacaaaagtccctcagacattgattcttaaattcaaaacaccaaaggcattgtatgtaccttttcatgttttctaattgtgaagaaaataaattttacttaaaatgttaatatctgaataaagtatgcattcataattatgttcttgtctttaaagttaattttccaagcagaactaaatcagttttatcttcagtagatcttttagaaaggaagcaatcctactaggaagatacactacaaatgtttattgtggtaatctttgaatagtaaaatgaaaggtgattttggtttccttttctatatgttcttgtattatatttttgaggtttttctctcagttcttttctgtgacttttaaatcagggaggaaaaattaattcagtctaagcacttaatgtttcttccacaagaagtatcctcatggctattttgttattttgtttcacttaggggaaaatggctttgttggcctcaaatagctgctttattagatgcaatgaagcaggggacatagaagcaaaaagtaaaacagcaggagaagaagaaatgatcaaggtaatgatgccattttatacagatgactgaattcacacatgcgatgtgactgtatctctttaaaatgttaagtcatcatttactgtcactttaaagattcagttaatagctttttataatgtggtgtttcaaatagactcatttttaattataaatcccatagttgatggcttgtttatacaatgtggtagagaaatcagtgcatctaggagctaccttgccattatctccatggattagtatctttttctggtagttccacatgctctttttaagcttccattttcttgttttcttgcgtgtattttaaaatctaattttttaaatagataacatgtacatgtggtccaacatttttaaataaaagcatatgaagatgaagatatatgcctgccatgcatcttactcacctgtgtcccagctccggttcctctttccctttgtttttttttttatagcctcctaaaatttctttataaacatatgaatatatttataattttcaactgttttacactaaaggcaaccttctctatagtcttctcgactttgatttttttttccttaaaattgtatcttggagagttttctactattagtttgaatgtagaaagttttctctttttcttgcttttcctctctttctctctctctcttttttaacagccacataatattccattttagggatgtaccttaatttatttagtcttttgtagatggaaatttaggttgtttccagtcttttgctcttctaaatagtgctgcagtacataacattgaatatgcatcaatttgtagatgtgcgggtggacctgcagataaatttccagaagcagaattaccaggtcggggtatacgtgtttgtatttacataatgcttgagcttctgtgatgataatcactctatgaaacattaaaaatcatagcagaactgctggctccttagcccttacattttaaaaatatttttattaatagtacccatcttctttgcattaggagaaacatgaatcacataaaacatgatttttattttatttttaaaatttgtgtgcatcactaagctggaaataaaagttccttattccaggctaaattccctcatccgtagtcagatgcattatccattgcaccagtggcctgtgccctccctaatcctactctttgttttacatcattgtaaaagttacacagacatcttcatatcaaggtgaaattctaaataatactgttaatataacctagataggtagttaactggaatttgatgaaaacatttaaggcttaattttttagactcacaaaagccactgatctttaatgataaacatataccaggatgtgtctaaagaataactcccgccttcttgacacatggcttttctgtgtcttggcatttcatcgcagtactgagcatcctgaaccttgctttgtttgtctctgttgggaatcacaggttgcatccagtctgacccagatttgctctgtaaggcattgtgggggccagagtggaaggctctaagagagggggcaaatgccttttctaaaatgcccttcgttcttataattagagcataaaaatttatgttacatttttctctactaccagtgtaatttaaaagcatctatcaattctctgtatgtgcttcatgttagatttctggtcatatgtttgattttcttcttagaatagtcttgatttcagataatttcaaatctaaagctcaaacaatttcaatttaaaatgtaggcattttcttacagttagagaagtgaaatgttatacttttcgttgcatgcatccggcacatgcgcacatgcgttatagtcttgaatttccataatgatcctgtgaggtggatgtgagctcagccttacagacaggaagacagcctctgaccctccttacatcctcgtggtttttgtcagtcacttcatggaaatcacagtgatttcaaggtgtggtaggacaggatgtgtacccaggcccagctgactccagaggccactctcagtatttcatagcacattgcttctcaagaaacaggtcattgaggaaatgcagatgggtttgtgacttacatttaattttacttatttatattttattgtatcatgtgtaaattatttttcatctggatatcatcacaaaagtgttattgaaggcaacaattgcaaatatatgtgcagtgctttgcacttatacaaagatacaaagatacttacacaaagattgcgtttttcactatttaaagaaattttcagatgaaataccaagttttctgggtctctttggttagtcaagtacttggaagctctgaacagtgattatttaggacacttttcgtaccatttaattgcaagctctcctaatctctgtcagcccttcatctttatgaccttgccttgtctaccagaacacacatccctcttactaaaggtagcattgtgctacaggccctagcagggaatgttttcaggtctgggacccctctaatcaaaactgtcacaaagatgtcattggcacaaacgcgttatttgtcatcactgtctaagcagccctggaactggactctggccacagagatcccttaggagacatgagtccttaccattgccaattgcctgttctgtgggcgatcctaatcgttgaatgcagaacaattaatttatgacatgtgatagtaagcatctgtccaaacttaggaggatataagaagctagtaaaagaggtgggttccaattaattaaaaacaagttgtgtaatgttaaaagttttaatactttggtaatagtctgtgcaatgtaaaatagctattaagctttcaatctgatcaaatgaacacttgtctactagggataatttgatcctagtgtattcacttggaggacaaagttaaattaactaatgattgctttattgcctagcaggatctgatgtgtaaaatgtttctgaaataattttgtctgtagtgtttctgacacaagggctgcggaggaagcatgtgacagcacttactcatatagattatatatatgaagtaaaaacacatagccagaacctgtctttttctgattatagttgctcagttaattttttcttctgcataagaaatcatcttgaatgttcttatgtgacacataaagtggggaaggtggaagataaacatataacccattggattctcttttccaatatctagattagatcctgtgctgaaaaagaaaccaagaaaaaagatgacattccagaagaagacaaaggaaatgtaaaacaatgtgaaatcaattatgtgtatgtatgcttttccttttagacctacagatttgacagtgaagtgcttctcaaagtgctttcaaaataaattacctaattagctggggatggtgttgcatgcctgtaggcccagctactcaggaggctgagacaggaggattgtttgagcccaggagttcaaggctgcagtgacctctgatcaccactgtattccagcctgggtgacagagcaagaccgtgtctgaaaaaatgaaaactgatagacaagaagaggcaacacaatgtagcctctaggacagagcactgagctaaatgcttttcttgaggtttcaggtttcctaatcatcctaccagctcccaaagctagtcacttgggttagtcaatctctctattcattcatagaatgggcgtgatgccagtcaaaggctgtgctatggtcaggacagaggggactccagccagcatgccctaatagaagtggggccttctgctacccagtcaatgagtggccctcctcttgagaggtcatgaaggtcatctttgttgttcaaaagctccagcttattaaaaaaatacaattagactttttttttctcccccaagacagagtctcactctgtcccccagactggagtgcagtgccactatctcggctcattgcaacctctgcctcccaggttcatgtgattctcctgcctcagcctcccgagtagctgggactacaggcacgcgccactacgctcggctaatttttgtatttttagtagagacggggtttcaccatgttggccaggctgttctcaaactcctgacctcgagtgatctgcctgccttggcctcccaaagtgctgggattgcaggcatgagccactgcacctggcctacagttagacttttttaataagtgaaaaaagaaattaacagtatttataaatttaatagtaaatatgtgtaatcagagtttgaggtatttttcaatgaagacattttctttgcagaaagaaatttcagagcttccaagaccacaaacttaaaataagtaaagaagagagtaaaattcttaaaaaggctcagaaagatggatttttgcatgagacgcttctggacaggtagctatttatttacttattttcactattttcagtagctaatagaaatggcatgtagaaaacctatattctcttaaattactgtagttttcacatttttgtctttatttataatttatgagtgtggcaatattacctagagaggacatcatgagtttgggaaaagactgtcaagaaagaatatctaaaaattataaccgattataagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattcatatttattactcttcctatgtagataagtaatgtcctagatttacaacatagaaaaacaggtagagacgtttagctgtgagtgtaaaagtataaatcaattaagtgccagattttgataatcaccagccgctcatttaagtcctatgttacaaagttactcttaccctttttttacattacttgataaaggcaatgtttaattacatatttcctgttaactagctggtagagttcatacctaaagtcagtaaataatgttaagaattttttccagctgagcaaatggatatgtatctagttgtaagaaatcaagaagaggatataaaatataatcaggatgtggactctgaaacggaataacctctttgtcctgtaacttttttcacttgtaataatacagcattctcaccctattaaatggaaatttagagcacccttaaattccggaataattaaaattgctatttggattgaaaaagcccttaggcaatatttattgaatattaggaaataacttttataagattagaatccattttttatagaaaccaaatttaaaagtatacatattttaatatgtgttgtggtaatacaataaccacaattgaacacacagttttaaagctttttatatttagtagcagttgaatatatatggcatgttttacatagattaattttactatttttctttgtttaaacaagagaaccaaattgaaagccgacagatactgcaaatgactggaatttttgtttctgccttatctttttgtgttttttttttctgaataaaatattcagaggaaatgcttttacagagttcttgagttgttgtgaaattattgtttagctagtagctagtttaaccaggattaaacaagtttaatcaggattcttcatggatgtacttccttggctaactacagtttttcacatggaaatgaaacttacagtacacacttaacgtatcacagaatttttttctggatttcctgtcctgaagcatgaagtgtactagaaaccaattcttcctgcgctacttgtggaatctttcttactggatcataatcttactttactttatacaatagatgcttaatcagtgcctttaataggaagttggaaactccaaatccaatcaacaaggctttgattctgcctcctaagtactacccagatcacagacaatccaaatatcagaactaggggtctgggcagagaggacaaatcatctattagggagtgggacagaaagtggaaacattacaaaggagcaagtaggctcagaacagaggggagagtagtactggggaaactccctacggaggacaggttagccacagtggatatgtatgtgatgcttttgtcctcgtgggctggaatggaagctgataaagaagttcagacgctacgtgttgcttaggtctgcttcgttgaagcctgtctctttcagagttcctaaacacaatattcccatggcatctaatcccagtgagtgctccaaagccaggctgtgtatcagatgccacgggaaattctgcctcaggactgaggttggttcaagcatctggatgatgtcaaaagtccacattgtgtgctggcctaacctgaaagaccctatctagttctagcctttaaattccttctgtcaccaaatctggagttacatggcatctgtacaatctgggtagctgaggcatgggatcagccctttaaaggagattttggagctttcattgtaggtctagcttcaacttggcactcccagttccaatagctggactttctctcatcgtgtgttctgatccttggattgggaaaaaagtaaccactctgatcccacaatgcagtggttccagttcccaactggtgactattttgcctcccaggggacatttttggttttcccaactggaatgtggtgttagagagtagaggctagggatgctgcgaagcatgtggcagaatcctgttccacccagaatgctaacagtgccaaggttatggagccttcccacccaagggcttggtctattccttgcttttgccagctgcctaacccttaaacacaacagttcaaatctatatgcataagcatctcctagggaccctgcacgtttccaatatcgactactgagacccatccgtagagatacaggctaggaagtctaggattgggctcaaaatttgcattttaacaagtactccaggtcattctgaagcaagcgatacaaaccacagaatgaggaacaccgccttcaagagactgagtcttgcttcccaacactagcttggtatctgagaccatctgcctgctgactggcttttctggcacaaacattctgcatgtaggcccagtgtgttcctcgactccatatcaacccgttcaccctcatgttcccttggttcctgtccccagtccagcgagcagaactgattacagatcttgacaacagaaggtacagatttaaaataacttgcctgttcccgtggaatttatccactagtgaaggaggacaagtggacaaggggagagggtaggtgggcgctccttcccttttcctcccattccactttatacaaaccccagctagaccactgggagagcaacggaggttaagaatgactgcctctaaatattgtcatttggtccactcttcttccatcttgtatacaaggatatcatgactttggtttaaagcactactgaaaccaagataaactgtggcttagcattcccccgatggatcagtctagtaatcttatcaaaaccaagattacctaaaagcactaaccaaaggaaaagctccctcaccccaacctatgactgctcacatttttcagattgaatcatttcaattgtattttaagatccattgactctttaccacctccaagctgctcctgaacacaactgattattttaattttgaaaactttctcacttctagaatttccacttgagcctttgttattattgtagtttcttcttctctgctgtgatttcctatccatttattttaagggtttttggggttttgattttagtaagaattacaataactactttaaaaatccgcactaattccaacatctgggtcatctcgaagtcagtctctattgattgcctttttctttgaatatgtttctgtatttttttgatataatgggattgaattctgaagattgtaaaactagattttgttttgttcctctgaaaattttgata

SEQ ID NO: 20 - DNA, 23561 bp, Homo sapiens
tcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatg

SEQ ID NO: 21 - DNA, 23518 bp, Homo sapiens
tcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatca

SEQ ID NO: 22 - DNA, 33740 bp, Homo sapiens
catcactgcacagaatgcaatatgggagggtttcactaatggttaaccataaccacactccagcgtgagcccagccactaggcaatgtgctgataaggattctaagtggtttatgtggactcctcatgacctatgacacacatacgtttacagtggagtggaacgaggcaggagggcttctctttgtcatagtctaccagctctgcagaggtgtcagctacatccggattggctcagggagcggccgtcagaagacttacacgtgtttaataactgaggttgtgtgtgtgtggcagggggtgggtaactgtgatgagtttggtgtggcagagggggagccatagcctgtgaagctggaaagtgtatcaggtttggtcatcaacaggcttgaacatgaagtacaggaacgtgcatcttatttttggaagatggagccccgttgggggaatttgagcagtggagggtcacagccaggtaagatggtcagaagaggcctcggaagtgatgagagggatggactggagtagggatgggagccagtagggggccaggagggaggttggtgcagtgcacagacagggcgtcctcggtccccagctgagcttagactgtggggatggaccagcggacacgggtggagccgggtgaggagggatgtgggcagagaggtttggatttgttcactgtgtgtgaagcagaagagtgtgaggagcttttccactctctgccttggttgatgggaggaaccagtggggctgccgcaggacagacgacccgcgtgggagaaggaggctcggggagatgtttctaagacttaacttgctcacagagggaagcacaagcttccttcgagcctgggctttgttttcccaaacaggtcccttcactgactttcttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatcttttgtatttttagtagagacggggtttcaccgtgctagccaggatggtctcgatctcctgacctcgtgatccacccgcctcggcctcccaaagtgctgggattacaggcgtgagccatcgcgcccagccaactttcctgttaatgagtagcactctttttttctttcttttctttccccctttttttttttttttagacatggtcttgctctgtttcccaggctggagtgcagtggcgtgaccccagctcactacaacctccacctcctgggttcaggtgattgtcctgcttcagcctcccaagtagctggattacaggcacgtgcaaccacgcctggctaatttttgtatttttagtagagacagagtttcaccatgttggccaggctattctcgaactcctgaccttaaatcatcctcttgccttggccccccaaagtgttaggattacaggcatgagccatcatgctcggcctcttttttctttttctttttttttttttttgtttttgagacagagtcttgctctgtcacccaggctggagtgcagtggcgtgatctcagctcactgcagcctccacctcccaggtgccagcgattctcctgcctcaatctcccagttagctgggattacagatgcgcgccaccatatccagctaaattttgtattttttagtaaagacagagttttaccatgttggccaggctggtcttgaactcctgacctcaggtgatccgcccgcttcagcctcccaaagtgttgggattacgggcatgagccaccatgctcggcctcttttttctttgcttaaaagatgaggcctgttgcccaggctggagtgcagtggcactatcatagctcactgcagccttgacatcgtggctcaggtgatcctcccgcctcaggctcccgagtggctgggactacagacgtgcacctccacagccactacttatttttgtagcgatgtctatcagctggtgaatagagaaagtgtggtatatccttacaacaaaatattattcaaccgtagaaaggaatgaagtactcatacatgctacatgtgtgaaccttgataatatactagataaaagcagtcaggaaaaaaaggtcacatatgacgttatttcatttataagaagtatccagcctgggtgtggtggctcattgcctgtaatccagcactttgggaggccaaggcaggtggattgcctgagtttaggagtttgagaccagcctgggcaacatggtgaaataccatctctaccaaaaatacaaaaaattcacccggcatggtggcatgtgcctgtgatcccagctacttgggaggctcaggtggcaggatcgcttgagcctgggaggcagaggttacagtgagccgagatcacaccactgcactccaacctgggtgacagagtgagtccctgtctcaaaaaaaaaaaaaaaaggtattcaaagaaggccaatcgatagaggcagaaagtaggttaattgttgcatgggattaggtgggagtgattgcttgatgtaaactcggtttccttctcggtatgataaaaatgtttcggaatgagatagaggtgatgcttacaccatattgtgaatttactaaatgccacaaaatagagttgtatctcaataaaaatatatttgttgggccgggtgcggtggctcacgcctataatcccagcactttgggaggcaggcagatcaagaggtcaggagttcaagaccagcctggcaaaaccctgtctctactaaaaatataaaacttagccaggcgtggtggcatgtgtctgtaatcccagctactcgggaggctgaggtagaatggagcgagactccgtctcaaaaaaaaatatatatatatgtaaatatatatatgttgggcatagtggtgcacacatgtagtcccagctacttgggaggctgaggcaggagaaccacttgaacctgggaagcggaggttgcagtgagccgagactgcaccattgcactcctgcctgggcaaaaagagtgaaactccatctcgaaaaaaaaaaaaaccacacacacacacgtagataaaatcaaatattctgtattccataaatatgtacaattattatttttcaattaaaaactcttaagctgggcacagtggctcatgcctgtaatcccaacactttgggaggcggagatgggaggctcttgagcccacaagtttgaggccagtttgggcaacatcgtgagatcccattgctacaaaaaaatttaaaatatatttttaaaaaactctaatacagtagtccccctttatctgtaattttctttctgtgttttcagttacctggtggtcaaccatggtccaaaaatattaaatagaaaagttaaggaatcataagttttttttttttttttttattgatcattcttgggtgtttctcgcagagggggatttggcagggtcataggacaacggtggagggaaggtcagcagataaacaagtgaacaaaggtctctggttttcctaggcagaggaccctgcagccttccgcagtgtttgtgtcactgggtacttgagattagggagtggtgatgactcttaacgagcatgctgccttcaagcatctgttcaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacaccgcaaccatccgatttctcaatcttttccccacctttccccgctttctattccacaaaaccgccattgtcatcatggcccgttctcaatgagctgttgggtacacctcccagacggggtggcggccgggcagaggggctcctcacttcccagtaggggcggccgggcagaggcgcccctcacctcccggatggggcggctggcctggcggggggctgacccccccacctccctcccggacggggcggctggccgggcgaggggggaatcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatgatcgacagatagtccagaaagcataggctgtagattttgttccagaacctcctgggatcatcagattgaacacatgagggtgggagactgccatacaagctgggaaggaggaatcagatgatattgtcatgaattcctcaagagttagtgtttgctggcctccaagaggcaaggatctctgggaacttaagacagagaagcacttcacactcacccatgagctcttttccgtgggtctcaactgggcattcacaacatagattggaagtaaggtggagacccaaaatttgtgatcagacatgattaccttccacagtgtgtggcctgaaatctcacccccctctggaggtcctagattgtcctccagagccttctgggatcatcagatctgtccctgaggctccaccacgctgaagggtgcattgtcctctccgctgttcacctcccggctgcatcttgggggtttctctggctgtgctgagcctcaaataacagaatcccgaggaacaccaggaccaagcctgccatgcccatgcggatgagattctccactgtgtaatccttggcgtgtgaggctggggatggtgggcaaagaggtcacagaggtccgggcagatcaacttcacccaggacccctggatgcccaacccagggcaccccccatccgccattgacagaacctgaccctctgtgcccgccccataactgtctgacttgttttgtgatggggtgagggtctcagctcctcctgagaatcaaaacagaaggggagagccctgagccagcctctcccctgggctctgcgttcttattcttccaggcctcacgacgtggcttttacggagttcctcaataaaccctccctctcctgcagcagggctccctccagtctcctcatgaaactatttcagttttcctgtgttctatgaatttcaacgctgctcctgagccatttcctccctcccatgggctggattctccaccttcactcccttctttcctagtgtcccagagctctcctgggtgcagagcctgagctgagcatttgagctcagagaggacagggtcagggccctcacctgagaccacgagctccagggagtcactggcctgaccctggggggttgaggggctggtcctcaggacctcctgggtcaggacagggaggtgaagcctggggctaccttgctccccacatcagcccggctcctcctcctggctgggccccaacatctctctctgccttgaaccccccactcttcaccagcccagcctcagagcccctgggacacaagcccgtccttgaggggaggggagtgggatcctttgggagactcagactgccctgggggaggccgcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccatgagttccaggggctcactggggaaagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaaataaccccgtgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccatagcacctgtactggcccccgtgggaggggctcacagggcccagggtgaagttggcctgggagagcccagcctggggctgctggccagggcgctggaggaagtcacgttccccctccttatacagaacaaatctgtcgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcaagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccggggggtgtttgtataatagtaatagcatgtgaacctccacctgtggctgggggtcacggggcccacagggaacagggcctggaaccccccactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgttgtagaatcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccagctccagggggtcgctgggctctgaccagcctgcagagctgtaatagtggcagcggtatctccctgcatggtgctgtgtcatggatgggatggagaatctggccttgttcttgggttccagtgggttatttctgtccaagggctctgggcttccctctttatccagttggtactcctgggcctccaggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcggatctccccctccccatcttgaaatctcaccaaggcagagcagggctgtgagggcgggcgtcatggcgtctccttccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttcaggcgagggtgaccgtgggctcctcctccctctcagagcctccccatggggtctccctccctccttcagctcgtccatcagttcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggcttcacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagcggtggctccccctcccctgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcgttggtcccatccctgctgggcacaatcttgagctgacactgagtttgggggagtggggcaggagcagcggcaacaatccccttcatcaggctgatgcctggacagccgtgggagaaaccctttatgaaaggccgggtgcgtgggaggagctgtcccacaggaatgacaaccaagatacgtgaggaaaacacagacagttgttgaaat

SEQ ID NO: 23 - DNA, 28657 bp, Homo sapiens
gcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatgatcgacagatagtccagaaagcataggctgtagattttgttccagaacctcctgggatcatcagattgaacacatgagggtgggagactgccatacaagctgggaaggaggaatcagatgatattgtcatgaattcctcaagagttagtgtttgctggcctccaagaggcaaggatctctgggaacttaagacagagaagcacttcacactcacccatgagctcttttccgtgggtctcaactgggcattcacaacatagattggaagtaaggtggagacccaaaatttgtgatcagacatgattaccttccacagtgtgtggcctgaaatctcacccccctctggaggtcctagattgtcctccagagccttctgggatcatcagatctgtccctgaggctccaccacgctgaagggtgcattgtcctctccgctgttcacctcccggctgcatcttgggggtttctctggctgtgctgagcctcaaataacagaatcccgaggaacaccaggaccaagcctgccatgcccatgcggatgagattctccactgtgtaatccttggcgtgtgaggctggggatggtgggcaaagaggtcacagaggtccgggcagatcaacttcacccaggacccctggatgcccaacccagggcaccccccatccgccattgacagaacctgaccctctgtgcccgccccataactgtctgacttgttttgtgatggggtgagggtctcagctcctcctgagaatcaaaacagaaggggagagccctgagccagcctctcccctgggctctgcgttcttattcttccaggcctcacgacgtggcttttacggagttcctcaataaaccctccctctcctgcagcagggctccctccagtctcctcatgaaactatttcagttttcctgtgttctatgaatttcaacgctgctcctgagccatttcctccctcccatgggctggattctccaccttcactcccttctttcctagtgtcccagagctctcctgggtgcagagcctgagctgagcatttgagctcagagaggacagggtcagggccctcacctgagaccacgagctccagggagtcactggcctgaccctggggggttgaggggctggtcctcaggacctcctgggtcaggacagggaggtgaagcctggggctaccttgctccccacatcagcccggctcctcctcctggctgggccccaacatctctctctgccttgaaccccccactcttcaccagcccagcctcagagcccctgggacacaagcccgtccttgaggggaggggagtgggatcctttgggagactcagactgccctgggggaggccgcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccatgagttccaggggctcactggggaaagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaaataaccccgtgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccatagcacctgtactggcccccgtgggaggggctcacagggcccagggtgaagttggcctgggagagcccagcctggggctgctggccagggcgctggaggaagtcacgttccccctccttatacagaacaaatctgtcgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcaagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccggggggtgtttgtataatagtaatagcatgtgaacctccacctgtggctgggggtcacggggcccacagggaacagggcctggaaccccccactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgttgtagaatcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccagctccagggggtcgctgggctctgaccagcctgcagagctgtaatagtggcagcggtatctccctgcatggtgctgtgtcatggatgggatggagaatctggccttgttcttgggttccagtgggttatttctgtccaagggctctgggcttccctctttatccagttggtactcctgggcctccaggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcggatctccccctccccatcttgaaatctcaccaaggcagagcagggctgtgagggcgggcgtcatggcgtctccttccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttcaggcgagggtgaccgtgggctcctcctccctctcagagcctccccatggggtctccctccctccttcagctcgtccatcagttcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggcttcacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagcggtggctccccctcccctgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcgttggtcccatccctgctgggcacaatcttgagctgacactgagtttgggggagtggggcaggagcagcggcaacaatccccttcatcaggctgatgcctggacagccgtgggagaaaccctttatgaaaggccgggtgcgtgggaggagctgtcccacaggaatgacaaccaagatacgtgaggaaaacacagacagttgttgaaatgcattagacaga

SEQ ID NO: 24 - DNA, 33752 bp, Homo sapiens
catcactgcacagaatgcaatatgggagggtttcactaatggttaaccataaccacactccagcgtgagcccagccactaggcaatgtgctgataaggattctaagtggtttatgtggactcctcatgacctatgacacacatacgtttacagtggagtggaacgaggcaggagggcttctctttgtcatagtctaccagctctgcagaggtgtcagctacatccggattggctcagggagcggccgtcagaagacttacacgtgtttaataactgaggttgtgtgtgtgtggcagggggtgggtaactgtgatgagtttggtgtggcagagggggagccatagcctgtgaagctggaaagtgtatcaggtttggtcatcaacaggcttgaacatgaagtacaggaacgtgcatcttatttttggaagatggagccccgttgggggaatttgagcagtggagggtcacagccaggtaagatggtcagaagaggcctcggaagtgatgagagggatggactggagtagggatgggagccagtagggggccaggagggaggttggtgcagtgcacagacagggcgtcctcggtccccagctgagcttagactgtggggatggaccagcggacacgggtggagccgggtgaggagggatgtgggcagagaggtttggatttgttcactgtgtgtgaagcagaagagtgtgaggagcttttccactctctgccttggttgatgggaggaaccagtggggctgccgcaggacagacgacccgcgtgggagaaggaggctcggggagatgtttctaagacttaacttgctcacagagggaagcacaagcttccttcgagcctgggctttgttttcccaaacaggtcccttcactgactttcttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatcttttgtatttttagtagagacggggtttcaccgtgctagccaggatggtctcgatctcctgacctcgtgatccacccgcctcggcctcccaaagtgctgggattacaggcgtgagccatcgcgcccagccaactttcctgttaatgagtagcactctttttttctttcttttctttccccctttttttttttttttagacatggtcttgctctgtttcccaggctggagtgcagtggcgtgaccccagctcactacaacctccacctcctgggttcaggtgattgtcctgcttcagcctcccaagtagctggattacaggcacgtgcaaccacgcctggctaatttttgtatttttagtagagacagagtttcaccatgttggccaggctattctcgaactcctgaccttaaatcatcctcttgccttggccccccaaagtgttaggattacaggcatgagccatcatgctcggcctcttttttctttttctttttttttttttttgtttttgagacagagtcttgctctgtcacccaggctggagtgcagtggcgtgatctcagctcactgcagcctccacctcccaggtgccagcgattctcctgcctcaatctcccagttagctgggattacagatgcgcgccaccatatccagctaaattttgtattttttagtaaagacagagttttaccatgttggccaggctggtcttgaactcctgacctcaggtgatccgcccgcttcagcctcccaaagtgttgggattacgggcatgagccaccatgctcggcctcttttttctttgcttaaaagatgaggcctgttgcccaggctggagtgcagtggcactatcatagctcactgcagccttgacatcgtggctcaggtgatcctcccgcctcaggctcccgagtggctgggactacagacgtgcacctccacagccactacttatttttgtagcgatgtctatcagctggtgaatagagaaagtgtggtatatccttacaacaaaatattattcaaccgtagaaaggaatgaagtactcatacatgctacatgtgtgaaccttgataatatactagataaaagcagtcaggaaaaaaaggtcacatatgacgttatttcatttataagaagtatccagcctgggtgtggtggctcattgcctgtaatccagcactttgggaggccaaggcaggtggattgcctgagtttaggagtttgagaccagcctgggcaacatggtgaaataccatctctaccaaaaatacaaaaaattcacccggcatggtggcatgtgcctgtgatcccagctacttgggaggctcaggtggcaggatcgcttgagcctgggaggcagaggttacagtgagccgagatcacaccactgcactccaacctgggtgacagagtgagtccctgtctcaaaaaaaaaaaaaaaaggtattcaaagaaggccaatcgatagaggcagaaagtaggttaattgttgcatgggattaggtgggagtgattgcttgatgtaaactcggtttccttctcggtatgataaaaatgtttcggaatgagatagaggtgatgcttacaccatattgtgaatttactaaatgccacaaaatagagttgtatctcaataaaaatatatttgttgggccgggtgcggtggctcacgcctataatcccagcactttgggaggcaggcagatcaagaggtcaggagttcaagaccagcctggcaaaaccctgtctctactaaaaatataaaacttagccaggcgtggtggcatgtgtctgtaatcccagctactcgggaggctgaggtagaatggagcgagactccgtctcaaaaaaaaatatatatatatgtaaatatatatatgttgggcatagtggtgcacacatgtagtcccagctacttgggaggctgaggcaggagaaccacttgaacctgggaagcggaggttgcagtgagccgagactgcaccattgcactcctgcctgggcaaaaagagtgaaactccatctcgaaaaaaaaaaaaaccacacacacacacgtagataaaatcaaatattctgtattccataaatatgtacaattattatttttcaattaaaaactcttaagctgggcacagtggctcatgcctgtaatcccaacactttgggaggcggagatgggaggctcttgagcccacaagtttgaggccagtttgggcaacatcgtgagatcccattgctacaaaaaaatttaaaatatatttttaaaaaactctaatacagtagtccccctttatctgtaattttctttctgtgttttcagttacctggtggtcaaccatggtccaaaaatattaaatagaaaagttaaggaatcataagttttttttttttttttttattgatcattcttgggtgtttctcgcagagggggatttggcagggtcataggacaacggtggagggaaggtcagcagataaacaagtgaacaaaggtctctggttttcctaggcagaggaccctgcagccttccgcagtgtttgtgtcactgggtacttgagattagggagtggtgatgactcttaacgagcatgctgccttcaagcatctgttcaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacaccgcaaccatccgatttctcaatcttttccccacctttccccgctttctattccacaaaaccgccattgtcatcatggcccgttctcaatgagctgttgggtacacctcccagacggggtggcggccgggcagaggggctcctcacttcccagtaggggcggccgggcagaggcgcccctcacctcccggatggggcggctggcctggcggggggctgacccccccacctccctcccggacggggcggctggccgggcgaggggggaatcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatgatcgacagatagtccagaaagcataggctgtagattttgttccagaacctcctgggatcatcagattgaacacatgagggtgggagactgccatacaagctgggaaggaggaatcagatgatattgtcatgaattcctcaagagttagtgtttgctggcctccaagaggcaaggatctctgggaacttaagacagagaagcacttcacactcacccatgagctcttttccgtgggtctcaactgggcattcacaacatagattggaagtaaggtggagacccaaaatttgtgatcagacatgattaccttccacagtgtgtggcctgaaatctcacccccctctggaggtcctagattgtcctccagagccttctgggatcatcagatctgtccctgaggctccaccacgctgaagggtgcattgtcctctccgctgttcacctcccggctgcatcttgggggtttctctggctgtgctgagcctcaaataacagaatcccgaggaacaccaggaccaagcctgccatgcccatgcggatgagattctccactgtgtaatccttggcgtgtgaggctggggatggtgggcaaagaggtcacagaggtccgggcagatcaacttcacccaggacccctggatgcccaacccagggcaccccccatccgccattgacagaacctgaccctctgtgcccgccccataactgtctgacttgttttgtgatggggtgagggtctcagctcctcctgagaatcaaaacagaaggggagagccctgagccagcctctcccctgggctctgcgttcttattcttccaggcctcacgacgtggcttttacggagttcctcaataaaccctccctctcctgcagcagggctccctccagtctcctcatgaaactatttcagttttcctgtgttctatgaatttcaacgctgctcctgagccatttcctccctcccatgggctggattctccaccttcactcccttctttcctagtgtcccagagctctcctgggtgcagagcctgagctgagcatttgagctcagagaggacagggtcagggccctcacctgagaccacgagctccagggagtcactggcctgaccctggggggttgaggggctggtcctcaggacctcctgggtcaggacagggaggtgaagcctggggctaccttgctccccacatcagcccggctcctcctcctggctgggccccaacatctctctctgccttgaaccccccactcttcaccagcccagcctcagagcccctgggacacaagcccgtccttgaggggaggggagtgggatcctttgggagactcagactgccctgggggaggccgcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccatgagttccaggggctcactggggaaagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaaataaccccgtgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccatagcacctgtactggcccccgtgggaggggctcacagggcccagggtgaagttggcctgggagagcccagcctggggctgctggccagggcgctggaggaagtcacgttccccctccttatacagaacaaatctgtcgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcaagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccggggggtgtttgtataatagtaatagcatgtgaacctccacctgtggctgggggtcacggggcccacagggaacagggcctggaaccccccactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgttgtagaatcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccagctccagggggtcgctgggctctgaccagcctgcagagctgtaatagtggcagcggtatctccctgcatggtgctgtgtcatggatgggatggagaatctggccttgttcttgggttccagtgggttatttctgtccaagggctctgggcttccctctttatccagttggtactcctgggcctccaggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcggatctccccctccccatcttgaaatctcaccaaggcagagcagggctgtgagggcgggcgtcatggcgtctccttccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttcaggcgagggtgaccgtgggctcctcctccctctcagagcctccccatggggtctccctccctccttcagctcgtccatcagttcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggcttcacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagcggtggctccccctcccctgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcgttggtcccatccctgctgggcacaatcttgagctgacactgagtttgggggagtggggcaggagcagcggcaacaatccccttcatcaggctgatgcctggacagccgtgggagaaaccctttatgaaaggccgggtgcgtgggaggagctgtcccacaggaatgacaaccaagatacgtgaggaaaacacagacagttgttgaaatgcattagacaga

SEQ ID NO: 25 - DNA, 29493 bp, Homo sapiens
ctttcttggtgatctccttggaccacatccctgtatcattctctctctcgaccctgagcccagggtccagagcagagaacgggatggggtctgggtaggggcccctcacttgcaaccaggatgttgggtgggggcgacgggggaccgaccttgggcaggaggcattgtgtccaccgcagcatctgtgctggcccccaggggggtggctcgcatggcccagggggacgtccaggaggtgctgcccatctaggcgctggcgggctgggagccccttgtcctggtcaatgcagagctgtcaaaaccggcctctgagtgatgctgaggggtcaggctgtctccagagagcaccggcgatcccggctgtgctgagagggagggctgagggctgcctggacgcccctgagatgaggcgactggtatttaggggatgcgtactctctggggcccgctggggcctgcagggagagctctcaccggtctcaactccatgccttctgccttgtgcttctggcccaagaggtcggggtcactgaccaccccgtgtccacctaaggcttccctggacacacagcagggagatgggcaatgagggtgggggttgtggccctgcctgtcacggtccccagcagtgcagatgaattagaccattgagccacagagcctggagggcagatgggtgtgctggtataaggagccccgggctctgtgttacaggtcatgtgttctcaccagtggccttgcaggaggggaacagccccttccccagggcctcgctctgctccccctgaaggatggggctgaggggacagcaggctctgggggcctttcagaccacatttgagtcaaaatttgacttccccatactctgcctgcttccacctcacccaactctcatccaggggtgacccttgttctagcacatgaggctgaggccagagagggcagggccttaggacacagcccagtcactgttctaattctagaggcaagccccttccatgtcctgagctctgtaatgcatcttttctttcatgagccttgcgatcaggcgatgtttattcagtggttaccacatccaggcatgctgccaggaggaggggagtcgtgggtgaagctgataggattcctgctggactcacagagcctgggttaatgacacattacccatgtttagataggaggtaattctgctccggtttcgacaagttgtaggaaaggaggaaaacatgctcatagcaggtgagcagcgtacacctgtcatgggagtgaggggtccttctgggggatggagagaccaagacgtgaacagtgagtgtggcacgcagagtgtcctccaccagaaacagtgtgggctgttctcagacctgagagtgagccaaaggaagctgggaccttgtcattcaggggacttgtgcaccgtgaagatttattggatgctatgtttaagaaaatggaaaatccggcccggcacggtggtttgcacctgtaatcccagcactttgggaggcggaggtgggtggattatgaggtcaggagttcgagaccagcctggccaacatggtgaaaccccgtctctactaaagacacaaaaaatcagccaggtgtggtggtggacgcctgtaatcccagctactcgggaggctgaggcaggagaatcacttgaacccgggaggtggaggttgcagtgagccgagattgcgccacagcactccagcctaggtgacagagtgagactccatctcaaaaaaaaaaaaaaaaaaaccggggaatctttagaaagcacagtggaaacagatgtctgtttttacaagcccatcactgcacagaatgcaatatgggagggtttcactaatggttaaccataaccacactccagcgtgagcccagccactaggcaatgtgctgataaggattctaagtggtttatgtggactcctcatgacctatgacacacatacgtttacagtggagtggaacgaggcaggagggcttctctttgtcatagtctaccagctctgcagaggtgtcagctacatccggattggctcagggagcggccgtcagaagacttacacgtgtttaataactgaggttgtgtgtgtgtggcagggggtgggtaactgtgatgagtttggtgtggcagagggggagccatagcctgtgaagctggaaagtgtatcaggtttggtcatcaacaggcttgaacatgaagtacaggaacgtgcatcttatttttggaagatggagccccgttgggggaatttgagcagtggagggtcacagccaggtaagatggtcagaagaggcctcggaagtgatgagagggatggactggagtagggatgggagccagtagggggccaggagggaggttggtgcagtgcacagacagggcgtcctcggtccccagctgagcttagactgtggggatggaccagcggacacgggtggagccgggtgaggagggatgtgggcagagaggtttggatttgttcactgtgtgtgaagcagaagagtgtgaggagcttttccactctctgccttggttgatgggaggaaccagtggggctgccgcaggacagacgacccgcgtgggagaaggaggctcggggagatgtttctaagacttaacttgctcacagagggaagcacaagcttccttcgagcctgggctttgttttcccaaacaggtcccttcactgactttcttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatcttttgtatttttagtagagacggggtttcaccgtgctagccaggatggtctcgatctcctgacctcgtgatccacccgcctcggcctcccaaagtgctgggattacaggcgtgagccatcgcgcccagccaactttcctgttaatgagtagcactctttttttctttcttttctttccccctttttttttttttttagacatggtcttgctctgtttcccaggctggagtgcagtggcgtgaccccagctcactacaacctccacctcctgggttcaggtgattgtcctgcttcagcctcccaagtagctggattacaggcacgtgcaaccacgcctggctaatttttgtatttttagtagagacagagtttcaccatgttggccaggctattctcgaactcctgaccttaaatcatcctcttgccttggccccccaaagtgttaggattacaggcatgagccatcatgctcggcctcttttttctttttctttttttttttttttgtttttgagacagagtcttgctctgtcacccaggctggagtgcagtggcgtgatctcagctcactgcagcctccacctcccaggtgccagcgattctcctgcctcaatctcccagttagctgggattacagatgcgcgccaccatatccagctaaattttgtattttttagtaaagacagagttttaccatgttggccaggctggtcttgaactcctgacctcaggtgatccgcccgcttcagcctcccaaagtgttgggattacgggcatgagccaccatgctcggcctcttttttctttgcttaaaagatgaggcctgttgcccaggctggagtgcagtggcactatcatagctcactgcagccttgacatcgtggctcaggtgatcctcccgcctcaggctcccgagtggctgggactacagacgtgcacctccacagccactacttatttttgtagcgatgtctatcagctggtgaatagagaaagtgtggtatatccttacaacaaaatattattcaaccgtagaaaggaatgaagtactcatacatgctacatgtgtgaaccttgataatatactagataaaagcagtcaggaaaaaaaggtcacatatgacgttatttcatttataagaagtatccagcctgggtgtggtggctcattgcctgtaatccagcactttgggaggccaaggcaggtggattgcctgagtttaggagtttgagaccagcctgggcaacatggtgaaataccatctctaccaaaaatacaaaaaattcacccggcatggtggcatgtgcctgtgatcccagctacttgggaggctcaggtggcaggatcgcttgagcctgggaggcagaggttacagtgagccgagatcacaccactgcactccaacctgggtgacagagtgagtccctgtctcaaaaaaaaaaaaaaaaggtattcaaagaaggccaatcgatagaggcagaaagtaggttaattgttgcatgggattaggtgggagtgattgcttgatgtaaactcggtttccttctcggtatgataaaaatgtttcggaatgagatagaggtgatgcttacaccatattgtgaatttactaaatgccacaaaatagagttgtatctcaataaaaatatatttgttgggccgggtgcggtggctcacgcctataatcccagcactttgggaggcaggcagatcaagaggtcaggagttcaagaccagcctggcaaaaccctgtctctactaaaaatataaaacttagccaggcgtggtggcatgtgtctgtaatcccagctactcgggaggctgaggtagaatggagcgagactccgtctcaaaaaaaaatatatatatatgtaaatatatatatgttgggcatagtggtgcacacatgtagtcccagctacttgggaggctgaggcaggagaaccacttgaacctgggaagcggaggttgcagtgagccgagactgcaccattgcactcctgcctgggcaaaaagagtgaaactccatctcgaaaaaaaaaaaaaccacacacacacacgtagataaaatcaaatattctgtattccataaatatgtacaattattatttttcaattaaaaactcttaagctgggcacagtggctcatgcctgtaatcccaacactttgggaggcggagatgggaggctcttgagcccacaagtttgaggccagtttgggcaacatcgtgagatcccattgctacaaaaaaatttaaaatatatttttaaaaaactctaatacagtagtccccctttatctgtaattttctttctgtgttttcagttacctggtggtcaaccatggtccaaaaatattaaatagaaaagttaaggaatcataagttttttttttttttttttattgatcattcttgggtgtttctcgcagagggggatttggcagggtcataggacaacggtggagggaaggtcagcagataaacaagtgaacaaaggtctctggttttcctaggcagaggaccctgcagccttccgcagtgtttgtgtcactgggtacttgagattagggagtggtgatgactcttaacgagcatgctgccttcaagcatctgttcaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacaccgcaaccatccgatttctcaatcttttccccacctttccccgctttctattccacaaaaccgccattgtcatcatggcccgttctcaatgagctgttgggtacacctcccagacggggtggcggccgggcagaggggctcctcacttcccagtaggggcggccgggcagaggcgcccctcacctcccggatggggcggctggcctggcggggggctgacccccccacctccctcccggacggggcggctggccgggcgaggggggaatcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatg

SEQ ID NO: 26 - DNA, 36764 bp, Homo sapiens
agagacgagtggtatttttggaaaaactgtgtcaaaaccagaaggaaattccaagtaagccggtgtttgcatataggggtgggagggagccggtcattgctaggcagggcaggcgccgagtggaggtgggggccttccctgcctgctggccctgggaccctgaccccgccaggcaagagacaggtgggacgggagctgaccagaggctgacgggttgctggggaaggtgaactgttggtgattgttggggaacacttcacagaatttgcttgctagtttcaaagcttgtgatgcggttgatgttgggcaagttcccagttttgtcttcacatgtaggggaagtgggttagcgtaggagaaggggcgttgagggaagtctgttcctcctctccgcgttcagtgcttctgtggactcacggtcaagaggttggcaggcttcccttttctcagccttgttgatcatctgtgttgggaaggggtttggtttctgaggaagtgagaaacctgaaattgtgcaaccccctcaggctgcaggctgtagttgattgggtccttatctggaggccttcagggtttgaggtcagggcagggacagttctggaacacagctaagttactgtaaaccacgtggagaagtccattgcggcttactcaagctaggtggttggcccttccttccctcagcgttgctacttgggaaatgacggtggtcttgtgtccatggggccagctgctgcaccatctgggctcactgtggtctccttccttggagcgtggggtctgggctagtggatggccggggcagcgtactcactgggctcctgggagctcccctgggaggaagagactgcagttgtctctggtctgagaggtggtggctcacctgggtgtagctcacaattgcggagctccacggcagcctggagggaggggagagtgggagttgaggtatgcggttctggggagaagcctacgggcttggaaaggaaaagggtcttcagggctctgtctacagaggcagcgagcggggcaacagagggagactccatctcaagaatttgtagagatggagtctcaatgtgttgccccggctgatctaaaacccttggcctcaagcaatccactcgcctcccaaagcgctaggatgacaggtgtgagccacagtgcctggcctgcgtgggtctgtttaatctccgggcctcttgctctccctttcttggtgatctccttggaccacatccctgtatcattctctctctcgaccctgagcccagggtccagagcagagaacgggatggggtctgggtaggggcccctcacttgcaaccaggatgttgggtgggggcgacgggggaccgaccttgggcaggaggcattgtgtccaccgcagcatctgtgctggcccccaggggggtggctcgcatggcccagggggacgtccaggaggtgctgcccatctaggcgctggcgggctgggagccccttgtcctggtcaatgcagagctgtcaaaaccggcctctgagtgatgctgaggggtcaggctgtctccagagagcaccggcgatcccggctgtgctgagagggagggctgagggctgcctggacgcccctgagatgaggcgactggtatttaggggatgcgtactctctggggcccgctggggcctgcagggagagctctcaccggtctcaactccatgccttctgccttgtgcttctggcccaagaggtcggggtcactgaccaccccgtgtccacctaaggcttccctggacacacagcagggagatgggcaatgagggtgggggttgtggccctgcctgtcacggtccccagcagtgcagatgaattagaccattgagccacagagcctggagggcagatgggtgtgctggtataaggagccccgggctctgtgttacaggtcatgtgttctcaccagtggccttgcaggaggggaacagccccttccccagggcctcgctctgctccccctgaaggatggggctgaggggacagcaggctctgggggcctttcagaccacatttgagtcaaaatttgacttccccatactctgcctgcttccacctcacccaactctcatccaggggtgacccttgttctagcacatgaggctgaggccagagagggcagggccttaggacacagcccagtcactgttctaattctagaggcaagccccttccatgtcctgagctctgtaatgcatcttttctttcatgagccttgcgatcaggcgatgtttattcagtggttaccacatccaggcatgctgccaggaggaggggagtcgtgggtgaagctgataggattcctgctggactcacagagcctgggttaatgacacattacccatgtttagataggaggtaattctgctccggtttcgacaagttgtaggaaaggaggaaaacatgctcatagcaggtgagcagcgtacacctgtcatgggagtgaggggtccttctgggggatggagagaccaagacgtgaacagtgagtgtggcacgcagagtgtcctccaccagaaacagtgtgggctgttctcagacctgagagtgagccaaaggaagctgggaccttgtcattcaggggacttgtgcaccgtgaagatttattggatgctatgtttaagaaaatggaaaatccggcccggcacggtggtttgcacctgtaatcccagcactttgggaggcggaggtgggtggattatgaggtcaggagttcgagaccagcctggccaacatggtgaaaccccgtctctactaaagacacaaaaaatcagccaggtgtggtggtggacgcctgtaatcccagctactcgggaggctgaggcaggagaatcacttgaacccgggaggtggaggttgcagtgagccgagattgcgccacagcactccagcctaggtgacagagtgagactccatctcaaaaaaaaaaaaaaaaaaaccggggaatctttagaaagcacagtggaaacagatgtctgtttttacaagcccatcactgcacagaatgcaatatgggagggtttcactaatggttaaccataaccacactccagcgtgagcccagccactaggcaatgtgctgataaggattctaagtggtttatgtggactcctcatgacctatgacacacatacgtttacagtggagtggaacgaggcaggagggcttctctttgtcatagtctaccagctctgcagaggtgtcagctacatccggattggctcagggagcggccgtcagaagacttacacgtgtttaataactgaggttgtgtgtgtgtggcagggggtgggtaactgtgatgagtttggtgtggcagagggggagccatagcctgtgaagctggaaagtgtatcaggtttggtcatcaacaggcttgaacatgaagtacaggaacgtgcatcttatttttggaagatggagccccgttgggggaatttgagcagtggagggtcacagccaggtaagatggtcagaagaggcctcggaagtgatgagagggatggactggagtagggatgggagccagtagggggccaggagggaggttggtgcagtgcacagacagggcgtcctcggtccccagctgagcttagactgtggggatggaccagcggacacgggtggagccgggtgaggagggatgtgggcagagaggtttggatttgttcactgtgtgtgaagcagaagagtgtgaggagcttttccactctctgccttggttgatgggaggaaccagtggggctgccgcaggacagacgacccgcgtgggagaaggaggctcggggagatgtttctaagacttaacttgctcacagagggaagcacaagcttccttcgagcctgggctttgttttcccaaacaggtcccttcactgactttcttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatcttttgtatttttagtagagacggggtttcaccgtgctagccaggatggtctcgatctcctgacctcgtgatccacccgcctcggcctcccaaagtgctgggattacaggcgtgagccatcgcgcccagccaactttcctgttaatgagtagcactctttttttctttcttttctttccccctttttttttttttttagacatggtcttgctctgtttcccaggctggagtgcagtggcgtgaccccagctcactacaacctccacctcctgggttcaggtgattgtcctgcttcagcctcccaagtagctggattacaggcacgtgcaaccacgcctggctaatttttgtatttttagtagagacagagtttcaccatgttggccaggctattctcgaactcctgaccttaaatcatcctcttgccttggccccccaaagtgttaggattacaggcatgagccatcatgctcggcctcttttttctttttctttttttttttttttgtttttgagacagagtcttgctctgtcacccaggctggagtgcagtggcgtgatctcagctcactgcagcctccacctcccaggtgccagcgattctcctgcctcaatctcccagttagctgggattacagatgcgcgccaccatatccagctaaattttgtattttttagtaaagacagagttttaccatgttggccaggctggtcttgaactcctgacctcaggtgatccgcccgcttcagcctcccaaagtgttgggattacgggcatgagccaccatgctcggcctcttttttctttgcttaaaagatgaggcctgttgcccaggctggagtgcagtggcactatcatagctcactgcagccttgacatcgtggctcaggtgatcctcccgcctcaggctcccgagtggctgggactacagacgtgcacctccacagccactacttatttttgtagcgatgtctatcagctggtgaatagagaaagtgtggtatatccttacaacaaaatattattcaaccgtagaaaggaatgaagtactcatacatgctacatgtgtgaaccttgataatatactagataaaagcagtcaggaaaaaaaggtcacatatgacgttatttcatttataagaagtatccagcctgggtgtggtggctcattgcctgtaatccagcactttgggaggccaaggcaggtggattgcctgagtttaggagtttgagaccagcctgggcaacatggtgaaataccatctctaccaaaaatacaaaaaattcacccggcatggtggcatgtgcctgtgatcccagctacttgggaggctcaggtggcaggatcgcttgagcctgggaggcagaggttacagtgagccgagatcacaccactgcactccaacctgggtgacagagtgagtccctgtctcaaaaaaaaaaaaaaaaggtattcaaagaaggccaatcgatagaggcagaaagtaggttaattgttgcatgggattaggtgggagtgattgcttgatgtaaactcggtttccttctcggtatgataaaaatgtttcggaatgagatagaggtgatgcttacaccatattgtgaatttactaaatgccacaaaatagagttgtatctcaataaaaatatatttgttgggccgggtgcggtggctcacgcctataatcccagcactttgggaggcaggcagatcaagaggtcaggagttcaagaccagcctggcaaaaccctgtctctactaaaaatataaaacttagccaggcgtggtggcatgtgtctgtaatcccagctactcgggaggctgaggtagaatggagcgagactccgtctcaaaaaaaaatatatatatatgtaaatatatatatgttgggcatagtggtgcacacatgtagtcccagctacttgggaggctgaggcaggagaaccacttgaacctgggaagcggaggttgcagtgagccgagactgcaccattgcactcctgcctgggcaaaaagagtgaaactccatctcgaaaaaaaaaaaaaccacacacacacacgtagataaaatcaaatattctgtattccataaatatgtacaattattatttttcaattaaaaactcttaagctgggcacagtggctcatgcctgtaatcccaacactttgggaggcggagatgggaggctcttgagcccacaagtttgaggccagtttgggcaacatcgtgagatcccattgctacaaaaaaatttaaaatatatttttaaaaaactctaatacagtagtccccctttatctgtaattttctttctgtgttttcagttacctggtggtcaaccatggtccaaaaatattaaatagaaaagttaaggaatcataagttttttttttttttttttattgatcattcttgggtgtttctcgcagagggggatttggcagggtcataggacaacggtggagggaaggtcagcagataaacaagtgaacaaaggtctctggttttcctaggcagaggaccctgcagccttccgcagtgtttgtgtcactgggtacttgagattagggagtggtgatgactcttaacgagcatgctgccttcaagcatctgttcaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacaccgcaaccatccgatttctcaatcttttccccacctttccccgctttctattccacaaaaccgccattgtcatcatggcccgttctcaatgagctgttgggtacacctcccagacggggtggcggccgggcagaggggctcctcacttcccagtaggggcggccgggcagaggcgcccctcacctcccggatggggcggctggcctggcggggggctgacccccccacctccctcccggacggggcggctggccgggcgaggggggaatcataagtttttaacaaatcaaaatatttctaaaaacctagagtaggcaggaaaggggaaacaacacacagcagaggagacaaacaaaaaggcacacctgaacacagtcatgcaccgcataacgatgtttcgctccactacacatttcatatgtgatggtatagcctatgtatgtagtaggttataccacgtaggtttgtgtaagtagactctatgatgttcacacgacggtgaatttttttttttcttttttttgagatggagtctcattctgtctcccaggctggagtgaaatggcacgattttggctcactgcaacctccgcctcccaggttcaagcgattctcctgcctcagcttcccaagtagctgggattacaggcatgcaccacgatgcccggctaatttttgtatttttagtagagacagggtttcaccatgttgagcaggctggtctcgaattcccgacctctggtgatccacccatcttggcctcccaaagttctgggattacaggcatgagccaccacgcctggccaaaattttttaatgatggctttctcagaacatatccctgtcattaagtgacatacggttgtaatgtcatcagtgattacattaaatataagtgatcaaaaagagattacaagattggaattttttttttttgagacagagtcttgctctgttgcccaggctgtagtgcagtggtgtgatctcggttcactgcaaccactgcctcctgggttcaagcagttctctgcctcagcctccctagtagctgggattacaggtgcctgccaccacacctggccagtttttgtatttttagtagagatggggtttcaccatcttggccaggctagtcttgaactcctgaccttgtgatccacccgccttggcctcccaaagtgctgggattacaggcatgaacccccgcgcctggcctgttgtttatattttatcacattaaaaaagcagaaggatgaaaaatgtattatgcaaacactaatcaacagataatttcactggcttgttagttgttttgtttttttgagacagggtctcgtccaggctgaagtgctgtggtgcgatctcggctcattgcagcctcgacctcctgtacccaagtgatcctcccacctcagcctctcaagtagctgggactacaggtgtgtgccaccacgccggactggttttattttttgtagagatggggcctcacaatgctgatctgactgactcgaactcctgagctcaagctatcctccccacttgccctcccaaagtattgggattacaggtgtgagccactgcacctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttgaggcgagggtgaccgtgggctcctcctccctctcagagcctccccatggggtctccctccctccttcagcccgtccatcagctcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggctccacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagctgtggctccccctcccccgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaaggaatttatgtctgggcgtggtagttcatgcctgtaatcccagcactttgggaggtggaggcgggcagatcacttgaggctaggagttcgagaccagcctgggtgacatggtgaaaccccatctctactaaaaatacaaaaaattatctgggcgtggtggtgagtgcctgtaatcccagctactcgggaggctgaggcaggagaatctcttgaacctggaagatggaggctgctgtgtgctgagattgcgcccctgtacttcagctgggacaacaggagcgaaactgtgtctcaaaaaaagaagcaatttactaaccatatatacctaccatgcaaacataacaaaatcaaagcataatttaatccagggcaagacagctgaaataataaatatatacattgggataaaatattcatgaaattttccagactgtatcatggaaagaacagaaattgaacaatagaaaatattgatatatacacgaagttgaatgagaagaaagaacgtgtctgtcacggtttcagaatgaaagaaggaagaaggatgttagttcatgatatgcatgaagagctaatggttgaaatttttacagaactgaagagaaaacatcagtttataactaaattgaatatctcgatcatggtaaagtgaaaaccatgaggcattaatttaaaataatcataaaactaccagagaaaatgtaaattacccttgaatgaatgacaagctcgtcgggactggagttccaaagagcaaacagcagccccagaagatacaggagaaacaaccacaagcgtttaactgtgaggagagagttctgtgctgggcctaattattactattataattatttattattattattattattatcttttgagatgcaatttcgctcttgttgcccaggctggagtgcaatggcgcgatctcggctcaccgcaacctggcctagttattattaaaggaccgagttgcagtgtcagctgtggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaatgtaaatcagggagtggaataatgaaccccaaatggagaagatgagatgctactgtgaataagtcaacagtacatacaaaaaacgaataagcatagatctatctgtaatctgtgtatatacaagtatatgcatttctactaagaatctgaaagagcaaggaaatggattcgcgtctctggagcctccagaaaggaatgcagccacgttatggccttgattttgtcctaaaagactgtgagataatgagtttgtgttgctgaagctgctcaatacgtgtaatttgttatggcagcaatagcaaaccaatactaacacaaacagcctttgaaaagaaaaatagatgatatttcacacttttatttatttatttatttattttattttattttgagacggagccttgctctgtcacccaggctggagtgcagtggcgcgatcttggctcactgcaagctctgcctgccgggttcacaccattctcctggctcagcctcccgagtagctgggactacaggcgaccgccaccacgcccggctaattttttactatttttagtagagacggggtttcaccgtggtctcgatctcctgacctcatgatccgcctgcctcggcctcccaaagtgctgcgattacaggcgtgagccaccacgcccggatatttcatacttttaaatcagcaatctgtgaagaagagaaagttatacactttcactcaaccaaccacatgtccttaaaatttacaaagcatcaattgagacacagtggaggatttgaagaaatattgatcagactttgatagattaagtgaacaaaatattcgtgagggttgcatggcacaaatgttcaatctcatgcgcaaatatgatgtttcgattgtttatatattatgtaaatttgtatagaaacgtttctggaatatacatatagcaacaaagtgggaatgcatatttctttatatatatttttttgaaacaaggtctctctctgttgctccatctgaagtacaatggcactatcccagctcactgcagcctcgacctcctgaggcctaggtgattctgccacaaccatttcctgagtagctgggactacaggatcatgccaccttgcctggctaaatttttttaatatgtatttttttgtagagacgaggtttcgctatgttgcccaggctggtgtcaaactcctgggctcacgggatctgcccaccttggccttccaaagtgttgggattactggtgtgagccactgtgcgaggccaggaatacttatttatgaaaacatattgatcagaaatatctatctttttttttttttttgaaacgaagtgtagctctgtcgccaggctggagtgcagtggcacgaactcggctcacggcaatctccaccttccgggttcaagcgattctcctgcctcaggcttgcgagtagctagaattacaggcgtgcaccgccacacccagctaatttttttgtatttttagtagagacgggatttcaccatgttggcccagatggtctcggtctcctgacttcttgatctacccgccttagcttcccaaagtggtgggattacaggtgagagccactgtgcccagccgtctctatcatttttacacagcaaagtaagcatccaaactgttactacaggtaacgtttcctgattagaagttcaattaaattagcagccaacaataagaagacatttagagaaaaagcaatactttggaaacaaataacattctaaatattcatgggttataggctggatgtggtggctcatgcctgtaatcccagcactttgggaggctgaggcaggtggatcacttgaggtcaggactttgagaccagcctggccaacatggtgaaatgctgtctctactgagaatgcaaaaattagctgggtgtggtggcatgcacctgtattttcaatgactcgggaggctgagacgggagattcacttgaacccaggaggtggaagttgcagtgagccgagattgtgccactgcactccagcctgggtgagagagtaagactccatcgcaaaagcaaaaacaaatattcatgggttatagaatcacacaacattaaattgatagaacattaacgaaaaatgtcaatgaaattataacatatgaacgtttgtaggatgtaaagtaagagagtgagagagagagagggagcacaacaattaccaaatcaagatggaaagaggcaccactacccatcctacagacataaaaggactagtgaagcaaaactaggaatctatgctaagatgttttacaactcacatttaatagaaaatatcttgaagtatacaaactaccaaaatttactcaagaacaaatatatagtgtaacatttcctatttttattaaagaaattcaactggccgggattggtggctcacacctttaattccagcaccttgggaggctgaggcgggcagattacctgaggtcaggaattcaagacctgtctggccaacatggtgaaatcccacctctactaacaatacaaaaattagccaagtgaggtggcgcatgcctgtaatcccagctactcaggagggtgaggcaagagatctgtttgaacccaggaggcggaggttgcagtgagctgagatcacaccactgcattccagcctaggcgacagagggagactctgaaaaaaaaaaaaaagaaaagaaaagaaattcaacctacactcagaaatctttccatagggaaatctggcctaaatgggtacactgttgatttctaccaaatatttgagaaagtaagaatgacatggaaactctagctatcattcagttctcactaggctcatcgacttcttcattccagtccatgggttcttatggacacatccagccagttcagtccaagttccttagtggggcagcagtttggtgctgttggtgttgctggaagctctttgacctcctttggaacagaaatatcaaacagtggtaccttgccccaaagtagagcggttgattctgcctttacacaggatacaagatccctaaaaacacaattatctcaaggtccttcaagcgctcagttcgaccctttgagaagaagcccaaccatggaacaaggagtgcagaccgcctgggcccacggacctgctccagcacctgttgggagaaggagtcctgtatcaaccaggcctttgccatctaccagccaaaaagcaatagagaatcaggagcagaggtgagctgaagcgcacaacgttccaaggccagaaaatgagcaactcaggaatgaaacaagagacaagcagctccaggtgctccttcagcgccaaggagagggcgtgggggtcatggggtggcaggggaagatttgctattcggcgagatgggccaatgaaatttgagaatttttttttttttttttggagacggactctcgctcggtcgctcaggctggggtgcagtggcccgatctcggctcactgcaagctccgcctcccgggttcacgccattctcctgcctcagcctccccagtagctgggactacaggcgcccgccaccacgtcaggctaatttttttgtattttcagtagagacggggtttcaccgtgatctcgatctcctgacctcgtgatccgcccgcctcggcctcccaaattgctgggattacaggcgtgagagaaagagtttgactttgaaagtgcaaatgcccaattcaacaaggaagagatgggcagagagtttcataataaacttaaattaaaagaagataaacttgagaaagaggagaagcctgtaaatggtgaagataaaggagactcaggagttgatacccaaaacagtgaaggacatgctgatgaagaagatgcacttggacctaattgcttttatgaccaaactaaatcctcctttgataatatttctggtgatgacaatagagaacggaggccaacctgggctgaaggaagaagattaaatgctgaaacatttggaatcccactttgtccaaaccgtggccatgggggatacagaggcagagggaggtcttggtttccatggtggcagagggcgtggtggcagaagtggtaccttgaccaccccttgaggatttcgcggcggattcagaggaggttccacgggtcgggagtttgcagattttgaatataggaaaagcacagcctttggcccctaaatagtctgaattgatagtactgctctctgaaagaaagacaacaaagctgctgcatagtctacaaacaagtctttgaaaacaggtgaatttctagctcttcatggtactggaaactgatttcagtctttgcgaagaacgaagaagtgaattggctgtatgtttgccatcagcactgggtttttgttttttgtttgtttttctgtttaatttcagagataaaatgcagttagttttcgggggaggaagccttatcttaagacatgaggattaaatatatttggaatagcagaaggttaaataatttcttatgtatagttaaactaaagcagtacttcagtgggacttataagtattgtgtcatcactgaaaggttttttttttttttttttaatcactgaattgtatttggtaattccaggttgcctgcagatagggccgtgatactgtgttctgagccaagaagggagggtgtgtgtgtgtgtgtgtgtgtgtgtgtgtgtgtgtatctttctcctcctttcttttggggaatcttgtaatattaaatagtctatttcatcaattaattagggtgctggatggtagagaattttgtcagtcaactaggtacacacggtaaatactgtttcttaggcaaacgtaacttttttatacagttgtaaaattccattatattccaatgccaaagaaacattaaaaactttgtaaagttgtataaaaagcaactaattttttacaaaatagatatcctaaagttagccaaaaaaaagagaaaagggcaaagtgatcatttttggcgtagggtaacccttagtttcttccctggtagtaatttcccaccaggcagatcgtctaaccccaaatcacctaaaagtgcaggcccaggacgtgcttatctgcccagtgagtcacctggaggggtggtgatgggggctgttgatgacacgctcctttcctttcccagcccgtgtgttctacctctgaaaagacatagcattttcatttgcagagcccattatagaaaaataagaacaaaaatattagaaggaaaagacatagcatcatttagtgttcattcatatgaatatgtatattgtctacagctatctatatctctgttttatatctatgtctgttacaccatcagagagcacctaaagtgcagagtctcatccacaaactgtttcttgcatctactgtaagaggccattccgatgctctgtcagccccagcagcacccaaccactacatggcacgcatcctatctcagatcatccccaggatatcacgtggccctgttctcattgccccactgatttcatgggcgtgcaggtccctcgatctgagattaagtcatgagatgctccatttaaacaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacaggtgagactctcagcgacagtggtggctgcttggtccttggtaagagggagtcgctggtgttggttccatgcatgtccttttttctttgattcttttattttattttatttagagacggagtctcactctgtcgcccaggctggagtgcagtggcgcgatctcggctcactgcaacctctgtcccctgattctcctgcctcagcctcccgagtagctgggattacaggcaccttccaccacacctggctagtttttgtatttgcagtagggacggggtttcgccatattggccaggctggtcttgaactcctgacgtcagataatctgcccaactcggcctcccaaagtgctgggaatacaggcgtgagtcactgcgcctggcagcatgtcctttttttcttgctccatggccacgacactcacgggcccctccagcacgcactggggctgctgacacagagctggctgaagctcacggcattaacccagtcatcagcggatccttagatctcctaaccccagctgtgggcgctcctgctagcttctcaggagaagctcctggtcgagagcagacgtttctcctgtcctcctccagcctcagtctccggcagtttctgtgtgcctgggccttgagggtgggtttgtctccgtgtttctgtccccgctcctcatggcagctgcattgtattgagtaggtttgtttgatggggacgggttttctgtccctattccaaatttgcatatctctaatggtatttgtctaggatcacagtccaggattgttctctgcactcctcctagggtagagggattttatgatccaccttcttccggccacaatgagtcattacctgggatctgaggtgggcagaattatctgagcctcttccaatggcttatgtcttttcctccatgtgagagaaacacctgggtgggaaatgagatttcaggccatgcacagtggaagctctttctgtctgatcactaatgtggggtctccatcttgctccaaatcagttttgtgaatgcacggttgagacccaagaaaaagagcctttgggtgagtgcacagcacccctctgtcttaggtccccagatatatctcaatttgggcttcttctggaacatgaaactatttactttgagtttcctacgaaaacatagtgctggccttagacttcctatcctgaaaccccacgtctatttcccaacctcatgcatggaaaagtgctcgaatctccataggatcagcaagatctctatagaatctccatgggccctccacaggacctccataagatctcaataggttctccacaggttctccataggttgtccatagaacctccacaggacctccataggatctcaatagaacccccacaagacctctataggatctcaatagaaccctcacaggacctccataggatctcagtagaacccccacaggacctccataggatctcaatagaacccccacaggacctccataggatctcaatagaaccctcacaggacctccataggatctcagtagaacccccacaggacctccataggatctcaatagaaccctcacaggacctccataggatctcagtagaacccccacaggacctccataggatctcaatagaacccccacaggacctccataggatctcaatagaacccccacaggacctccataggatctcaataggacatccacaggacctccatagaatctcaatagaacccccacaggacctccataggatctcaatagaacccccacaggacctccataggatctcaatagaacccccacaggacctccataggatctcaatagaaccctcacaggacctccataggatctcaatagaacccccacaggacctccataggatctcaatagaacccccacaggacccccatagaatctcaatagattctccataggacctttgcaggacatccataggttctccgtggatcttcataggacctcgactggatctccataggatcttcacagggcctccgtaagttcttcacaggatttccagagttgccacaggatctgccactgcagggaccagccggcatcctctacatcccaagatgctggaaatgaccacgtggtgatagtggttatggatttcctacaggagaatgtgtgaaaccatgttcctgggcaaccctgcggagtcccaatctccattcagatcctccaggggccaggctggagggggtgtctggtgtgtcactgtgtctgttcacacagaatgggggcttctgcagtaataatgggaaaccagcccagagatagaggcagggattggagttatgctgtcataatccatgaagtgctgagctgaggaaaccagctgagcttggactgtagcgttggacaggagacattgataaaaaggactctgtggtagaatggtgtggatttgttcattgtgtgtgaagaagaagatgctcagggaatgaaagctcttccattctctgacttggttgacaagaggaaccaatagggccatcacaggagcaatgaccccatgtgggaagcagactgaaggagatgtattaaaaacagttaactaagtcagagagagaaacagagcctcccaatacctggaaagcatggtttgttcctcccaaacttcctccctctgacttctttatttctctacgtagcagcacctcttcatttctccatcaaaggctctgagctgtttgagttcctcatatattctgatgatcaaacccttgttagaggaataggtaacaaatgtttctccctgcctctgtaggtcataacaccgttggttgtttcctgagctctgcagaagctttttagtttgatacacccatttgtctatttttaaattcgtttcctatgcttttgaggtcttactgatagaatgtttgcttagaccaatgtcttgaagcgtttcctctgtgttttcttctatagtttcatagtttcaggtcttactttgggtcttattctgtcttgagtagatttttgtatatcgtgagagacagaggttgagttttgtttttttgcatatggatatgcagttttgctagcagcatttattgaagaaactgtcctttacccaatatatgttcttggcatgtttgttgataatcagttggctgtcaatttgtggatttatttctaggttctttgttctgttccatttgtctatgtgtttgtttttaagccagtgccttactgttttggttactatagctttgtagtgtattttgaagtcaggtagtgtgatgtctccagctttgtttttttttctctacattgcgttggctattttgggtattttatggctctatattaattttagaattttttatatttcagtgaagaaagacacttgtatgttgataggaattacaatgaatctgtagatagctttgggtcctatggtcctttttgtaaacatttattgtttcaacgtgtgaacatgaggtatctttccagttttttcgtgtcctctttaatttttcttagagctttataattttatttgtagaggtttttaccttgtcagttaaatttattagcaggtcttttattgtttgtggctattataaatgggatttcattcctgaattctttttcagccagttctgttcttcagggtcaagcatcatgtaagttcccatgtaggaaaggaatccggaatgaacagcagctgcacacaaatgcctttctctgatttccacctcagaggggtccaggaggtgatcaggcacatggagcattgtcacatttggtaccaatcccagtgtgatccctaaaacaccacctgattgggttgagcctcatctctgaaataaccaagccctgtgtgatccctaaaccaccacctgattgggtggaacctcatttctggaataaccaagccctgtgtgatccctaaaccaccgcctgattggatggaacctcatctctggaataaccaagccctgtgtgatcatcctaaaccaccacctgattgggttgaacctcatgtctgaaataaccccaaggccatgttggtgtccttcatcccagttctggtggtttcaacataatgaaatcagaaagttatatggccacttaaaaatgtcaagtgcatgtcatgaagtactggacaaggtgtttccctttctgaggcccattcttacctgggtaagtggctcattgtctgcgtggactcaggtgaggttgatcaggcaggtgggtgtcatgttgtgaatgaaacacaaagtcaacctgtgagatcattgctctgacaggtcaagaaccacctggtttgccatttagtggccagtgcagcctgtggcattcaccaccacacttcaatctcagctccctaaatggcatgacaaataaagatagataggtacaaaaacagagatatgctattccctggttaaaatggctgttatctctaagacaaaaattaacagatgctgtcaaggatatggagaaaagaaacccttctaccttggtgggaacgcaagttggtgcagccaatatggaaaacagcatggaggttcctcaagaaactgaaagtagaacaaccacaccatccagtaatcgcacagatgggtatatttccaaaagaaagaaaatcagtatatcaaagaggtgtctgcattgccatgtttattgcagcagtattcacaatagccaagatatggaatcaacctatgtccatcaatggatgaatggataaggaacatgtggtctatatacacaatgaaataatattcaggcataaaaagaaggaaattgtaccatgttcagcaacacagatgaatctggaagacattatgttcagtgaaataagccaggcccagaaagaggagcatgttctcactcacgcggaagctacaaaagtgggccttgtgatggcagagagtagaatggttgtcaacagaggctggcaagggagtgtggaggacagggatggagagaggttggtggacgggtgcagaaatacaggtggagagaaggagtaagttccagggcctgagagctcagtagggtgaccatagttagcaacagattattgtattttccacatgagtgagaaatgaagatttggaatgttcccagcacagaaattataaaagttggccaggcatagtggctcacacctgtaatcccagcactatggaaagccgacgctggtggatcaccttaggtcaggagttcgagaccagccagagcaacatggtgaaaccccgtctgtaataaaaatacaaaaattagcgaggtgtgatggtgcatgcctgtaatcctagctactcaggaggctgagacaggaaaactgcttgaacccgggaggcagagtttgcagtgagccaagatcctgccactgcacgccagctgggcgacagtgcaagactctgtctcaaaataataaccataataacaaatgttcagggtgatgaatgtcctgggaacctttattggatcgttacacattgcatggatgaatcagattaccacatgctcccaagaaacatgtatgattattccgtatcaaattaaaattatgtgatttaccaataactcgaagtggattgagggtcaccaaatgaaagtcagcgttccagtgcccgcgtccagtggtccttggagtttccatgttgaacagaaccctccagtatttcctgatgtgcaagcactattttggattacataatctatttcctttatttatggggtctattttgagtttgcctccctagaaaataaatgctgcctctttttgagcttcatgtgcacaccttctttttatactcttgtttctttactcaacatcatgatggaaggttggtttgcattgctctttgtagattttgtctgtgcctctgcacggcctcgtagtatcccttggtggaattgaaccacatatgtttcctttgttttagatgtatttttgggttttatggctgttgtgtaatatgagcagcagtcctgtccatgttgttgtgaatgaaacctcaccatatgaacacattttcctctaggttctgtgctttgtgttcatagctgtgtgtctcttctttttttttttcttttttttttagatgaagtctcgtactgtcacctgggccggagtgcaatggcgccaccttggctcactgcaccaactggcgccaacttgcttccgtctcccaggttcaagcaattctcctgcctcagcctcctgagtagctgaaattacaggcacctgccaccacgcccagctaatgttttgtatttttagtagagacggggtttcactatgttggccaagctggactcgaattcctgaactcgtgtccgcccgcctcagcctcccaaagtgctgggattacaggcatgagccaccgtgcccggccatgtttcttctttttcactgggtacttctgatattttccccaaattgattcaagtaatttgcagtcctaccatggatgtattggatttctacgtgagccctactacctctgacatttgatattgtcattttcatcatgtgaaatgaatacctcaacattgatccctctcttcaggaatgatcgacagatagtccagaaagcataggctgtagattttgttccagaacctcctgggatcatcagattgaacacatgagggtgggagactgccatacaagctgggaaggaggaatcagatgatattgtcatgaattcctcaagagttagtgtttgctggcctccaagaggcaaggatctctgggaacttaagacagagaagcacttcacactcacccatgagctcttttccgtgggtctcaactgggcattcacaacatagattggaagtaaggtggagacccaaaatttgtgatcagacatgattaccttccacagtgtgtggcctgaaatctcacccccctctggaggtcctagattgtcctccagagccttctgggatcatcagatctgtccctgaggctccaccacgctgaagggtgcattgtcctctccgctgttcacctcccggctgcatcttgggggtttctctggctgtgctgagcctcaaataacagaatcccgaggaacaccaggaccaagcctgccatgcccatgcggatgagattctccactgtgtaatccttggcgtgtgaggctggggatggtgggcaaagaggtcacagaggtccgggcagatcaacttcacccaggacccctggatgcccaacccagggcaccccccatccgccattgacagaacctgaccctctgtgcccgccccataactgtctgacttgttttgtgatggggtgagggtctcagctcctcctgagaatcaaaacagaaggggagagccctgagccagcctctcccctgggctctgcgttcttattcttccaggcctcacgacgtggcttttacggagttcctcaataaaccctccctctcctgcagcagggctccctccagtctcctcatgaaactatttcagttttcctgtgttctatgaatttcaacgctgctcctgagccatttcctccctcccatgggctggattctccaccttcactcccttctttcctagtgtcccagagctctcctgggtgcagagcctgagctgagcatttgagctcagagaggacagggtcagggccctcacctgagaccacgagctccagggagtcactggcctgaccctggggggttgaggggctggtcctcaggacctcctgggtcaggacagggaggtgaagcctggggctaccttgctccccacatcagcccggctcctcctcctggctgggccccaacatctctctctgccttgaaccccccactcttcaccagcccagcctcagagcccctgggacacaagcccgtccttgaggggaggggagtgggatcctttgggagactcagactgccctgggggaggccgcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccatgagttccaggggctcactggggaaagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaaataaccccgtgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccatagcacctgtactggcccccgtgggaggggctcacagggcccagggtgaagttggcctgggagagcccagcctggggctgctggccagggcgctggaggaagtcacgttccccctccttatacagaacaaatctgtcgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcaagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccggggggtgtttgtataatagtaatagcatgtgaacctccacctgtggctgggggtcacggggcccacagggaacagggcctggaaccccccactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgttgtagaatcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccagctccagggggtcgctgggctctgaccagcctgcagagctgtaatagtggcagcggtatctccctgcatggtgctgtgtcatggatgggatggagaatctggccttgttcttgggttccagtgggttatttctgtccaagggctctgggcttccctctttatccagttggtactcctgggcctccaggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcggatctccccctccccatcttgaaatctcaccaaggcagagcagggctgtgagggcgggcgtcatggcgtctccttccggtgaccccgcgctctgcagagggatgagccctcagtgctggcaggacagagagacacacagggtgtggccgctcggaggctgggtccttcttgtcatggggttgtctcatcctcagcccacaggaagaggaactgccaccccaggaacctggctctgatttccccagggctgaagtgggggcaggcaccaggctctctgcaggcatttcagagagaaatggggtctccctgcccccgggccactgtctgcctgatttatctttatctcactgaggacggggacacagccgcaaatagacctggtgccttcctgagtcagcccctttcaggcgagggtgaccgtgggctcctcctccctctcagagcctccccatggggtctccctccctccttcagctcgtccatcagttcagcgttacggggtccttaccatggcagtcgtctctccagccctggagatgcttcagggaagacccaggtccatgctgcaggcagactcagatcagcagagacgcacctgacacctggctgtgtagtccaggctgagctgcgtgtagcagtgagcacagagaaatgcagggtctaccgtggtggctcatgcctggaatcccagtacttcaggaggctgtggcgggtgatggcttgaggccaggagcttcagacagtcctgggaaacagactgtgaccctgtttctacagaaaagaaaaaagtgagctgggcatggaggctcatgcctgtggtcccagctactcaggaggctgaggtgggaggatcacttgggcccgggaggcggaggcttcagggagctatgatcaccccttggccttccagcctgggcgacagagcaagatcctgtctaaaaaggagaaatagaggggataaagagaaatatatatatatatgtttcattgtaatctataatctgattctggggaaggtgagctgatttgtatttaattcctgattatcatctagggtttatgtgactttggacatgaatgtcacctctgagcctgctgtcatgaaccccactcatcacagtggctgtgggggtcagtggtgcccaggacatgggaggctcagccatggtgaatttccagaccagttcagacaggagggtggggacgggagaggatcctggtgctgggcttcacagtcgaggaggatgattgacgcccccactcaagagcccacatcggctccaaataccatgaaattctccttgtgatacgtctgaaatatgcagatcatcacagccacaggcagagaaagaggaaaaacagttcctcacattgagacgcatccccttccatgagcagagttcaatgctgagtggccacaggtgtctgggaccaccgagcgtcattagggaggaggaggctcccacctccatgtgggacagaagaggaaccccacgtcctcccaggcagggaggggtcagggctctgggtgaggctggaagcggtggctccccctcccctgtgtgtgtggacaggcgctggggggtctctgctcactcactggaggccacggtcagcgctcagcccctcccctgtgtgtgagaaacagattcaatccacggtggtcagacatgggcgtctgccccacaggtgagtgtgaggctggcgttggtcccatccctgctgggcacaatcttgagctgacactgagtttgggggagtggggcaggagcagcggcaacaatccccttcatcaggctgatgcctggacagccgtgggagaaaccctttatgaaaggccgggtgcgtgggaggagctgtcccacaggaatgacaaccaagatacgtgaggaaaacacagacagttgttgaaat

SEQ ID NO: 27 - DNA, 7385 bp, Homo sapiens
actggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacaga

SEQ ID NO: 28 - DNA, 3893 bp, Homo sapiens
agtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 29 - DNA, 1488 bp, Homo sapiens
gcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagc

SEQ ID NO: 30 - DNA, 66249 bp, Homo sapiens
aggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtatatatatactttatatatgtatatatacatatcctatgtgtgtgggtatatatatatatatatatatatatatatatatatatgaatgatgcatggagagatatctctccatgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgaggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctaggccatattgaggaaggccaatgcagttttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaactaaagagcttctgcacagcaaaagaaactaccatcagagtaaacaggcagcctacagaatgggagaaaatttttgcaatctattcatctgtcaaagggctaatatccagaatctacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattagctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttctcagaacattcttttttttttttttttttttttttttttttttttaagatagagtcttactctgtcacccaggctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcacacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacctagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagatacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactag

SEQ ID NO: 31 - DNA, 4217 bp, Homo sapiens
tcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatatttttt

SEQ ID NO: 32 - DNA, 62 bp, Homo sapiens
tctgtgtgtgtgtaaaggttattcaaattctttatcacttgcttttgctttttaggaagaaa

SEQ ID NO: 33 - DNA, 2510 bp, Homo sapiens
tctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggggaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttggggggctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatca

SEQ ID NO: 34 - DNA, 6579 bp, Homo sapiens
attgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcaccaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtca

SEQ ID NO: 35 - DNA, 7244 bp, Homo sapiens
aagtgctggttcaatcaatacattcaaactgatatatccaattattcaatccatactggtaaattaaattgccttctatcatttcctttctatgaacatataaacacaaacacatacacatttttaaatgattaaaactatttatccagacacaggaagacaaagcaaacccaggaaagatacagaaacaacagaaaaatgaatatatattttgtttatctgggagatttctctgaaagtgattgtaaaagaatacgtatctaccatttcactcttataatccttttaaatttcatccagaatatctcactttctctctacccatattccttggtgctgcttctctcctccctagttgctcctactccctcagtcctgagccctacctaaatttttccggccctaccttgtctactgagatgtctttagaatacactcaactgtcttgccatggccagagaatcttctccaagaaagaaaccatcaagtacttccacagccttccatcctacattctaccagtaaacacctgcccagttgcagggctgtgaccctgaggaggaaagatttatacgacaagtagaacctcgcctgaagccaagagagggagatcctccatgtcatcactctctggaatctcccataagaaaatggtagactctggtcctaaacccttaatttccacagagcgcattctgctcctatctgttcacccagtgattgacctaagggctgctttctataggagatcattgaatcacagctaaatttaagtgtctttgctttatagtctgcacatgccacttgttgtggtctactgcctaatcctatatcttaactgtataaatggcaggcagagcagcaataaagaacttacattcaaggtgttcttcctgcaattatcttcctccaagttttttaagggattataaatttcattatgaatgaaactgctaatagccacacaatttccaaatctcctgaagaaaaaaaaaatatgtctcaacactactttagaaacaacttattatttcttttttctcaaagtatataagtacttaaagacaatacactgtgtcttcgaatgttcctacagctcataaacccacacatgaaacatagtagaagtatgcacacgcacacgcacatatattcatatatgtaaaaatatattatgtaaatattatttaaataattaaacaagcaaatgaatgaaatatttacgaatgtatatgtcatgctcatgctgcattatttcctttttcctttaatatctaattttatgactatgcttgcatctctaggtgcatgagggaaattatagtaactattgaataagattatggtgggcatgatatgagtatattcatgtgtggtatacctgtcaatacccatatatctacactgcatctatggtatgttaatattattactagagtaagctattattattattttaagaattctagaagccacttattctgtttattatctttttaaagtaagaattttattccgtattctgttatttcttaaacatactaaagaaaactataaggcagtctatttggcttaaattactacttcctattaaacatgtagtttgagtaaatcactcaacttttccgaacataagtatattaatcacaagaatggaaaaactaatacatactttataaaactgccttgaggatccagcaatagaaataaaagaacttggaaaaggagagttcgacaagggtaaaattctcattattataattaaagtcaaaagcttcagttaacagataaataatgttattggctgcagcattcccttctgtttttctgctttctattaggttagagtgacagactctccaacctccaactggttagtgattggtcttgagaaaaatcctcagcactctctctcgaatctgctttgtcctgactccatagattacaggattgagggctggtgggacaaccacatacaggttggctaatataatatgtatatactgtgggatattatggccaaaacgatgtgtcaagaatgaaaaaaatgctggtgtaaaaaaggctaagataacaccaatatgagaaccacaggtgttgagagctttgagtcgagcttcccaggagggcaggcagaagacagcatacaggatcctgacataggagagaataataaggataacatccagtaacaagagagatatgttgccaaggccaaacctaatgttgactttgatgctggcacaggccagacgggcaatgcccatgtgctcacaataagtatgagggatgatacgatgcccacagaagggcagcctcagaaggagaaacaccagtggaacaaccatgtacaggctcctcaggacagcaatgcctgcaatgaggctgatgattttgctggtgaggatcatggtgtaccgaagaggtttgcaaatggcaatgtagcggtcaaaggccatggccaccaacacaatgctctccatagcagtgaagaaatggatgaagaacatgtgagaaaggcagcctccaaaagatatttctttggtattgaaccagaagatgcccaacattttggggatggtggctgtagacaagcccaggtcaatggaatccaacatggccaggaagtagtacataggctcatggagactctgctcagtctggatcacaaacaagagagcagtgtttcccaggagtgcaacaagatacacaaagaaaaaagggactccaatccaaatgtgcacatcttctagccctgggatacccagcagtaggaatgaagaaggatggaactgggtgtgattagacgtagacattcttcctgccatataaagctgctgggcacaccagcgacgattataatattcctattagtaattcttgttccacttcttcttttgttcagatttctagtcaaattcacaataacatattaatctttctttatatatattcatgagtaaggtaaaatactctccacaatttctcctagcctctcctgagcaacattggtaccaggaatagaaccagtcttattctactgccccttcacctaatatcaaagactaatataaaaagaaatggcagaagaatgtcatctgccaaataaaaatgcaaaatctggaatttagccagaactaaatgagaaaaataaagttccagggtcagtgtctatagaaatgttacacatatttttgcttcacgatcaaggtatttgtaatctcaactattcctctatttgggaatcaaaaatgtagtgtgtaaaaccgtttctgtgttgttatgcatttttacaggtatttgtgactactagactgtatacttctatatacaatttagactatactgtatacaatttgggactactagactgtatacttctgtatacaatttaggctgtatatactgtatacagtttgtgactactagactgtatacttctgtatacaatttagactgtgtatactgtatacaatttgtgactactagactgtatacttctgagagaagaaacaatttatcttgctcatatgcaggaaaaagatctgctacataatagttctcaatttaaaacctccacaaatagacattgattacaaggaggcaaaactgtgggtaattttaatgtcatattttaggaaataaataatttagtttccatcacacctgtgtttgagaaaagaagcttatccatcggatttggaaaatgggtaaaaacaaggaaaagaaaatacttgacaaagagtattttgcagctatgatggaacatggatgaagagataattttaatctagataatcctattatttggagagtgcataaatacacgcattcagtaaagaaactgtttatatataggccagctttttctgtggcaaggaaactaaatattctgggctacaaaattttcaaatatatctcagtcttatattcatgggaagaaagtagaagccctttggatgacctacagtttagctgctactcaaattctatcccagctgttttgtctctatggatgtctccaatatagtaaatcctgaatttacagatagtaaatcctgaatttacggatagtaaatcctgaatttacagatagtaaattcaaaatttgaagcaaaaagttcattactgcgcaacttacttttacttgggaaaaactagttttacagataatgcggaattggttaaatgtgacgtggcaactacacaaaaagcattgattacaatttaagaatacttgaacattgggggaagtcagaattgagacgtacgcagcagagataaaagtgtgtgaatgtcagcaagttctactttaatcctgtaacaacaaaaatgcattgctggtagtacctatttgaagcatacgaagaatagcaaaaatgagagattatttgataatttgggaaattatttcagagagagagagagagagagaatgtgtgtgtataaacttgggtgaaactatcagagataagggtataaacttcctgtttttcactaattgagaatacacaaaataggcagcgaaatacctttcacaatttatcccatcaaatattgaagaggttctctatgtatcagtggtaattaggaagtttaaatacaaaaaatgaataaaactggtcatatatccttaaggaaatcaccacgtagtaaagaagataaaattccaaacatgaaatttaagaactgtactgcaagtgctatggtagaaatgtgcacaggatgttttaaatgtagaggtgagtcaagaaaaattgtatagaggaagttaggcttatgctgacttacagagaaattcttctgacaaaaaagaaagaaaattttattctgtataaataagcaggggcaaagtgggaaaaaaagcacagtggccacttaggatataaaaatgaaatcagtcatcctcttcaatggtcttatccagagattcttattaagtctgatgtcttggtcatgtttaggggctccatacagcatgaactgaaaaaataaaaatatggctacattccaaggatagcaacttatcccatgtatctctgtggattttaaaagaagatttggaaattaatgcttcccttctccctaggacaacatcatttccaagtttataaatactgatcaaagcaaccaatcaattaattatccaataaatgtttacttaaccattatttcaacacatatttacatatcttccaatctctgctggatttaaaaataaaattggttctcagcccctgttttgactccctaactctaaggtcctacatggaattatatccagctatccagcagccacgtcctcagtgtgtcatcttcttaatctaccctattgcaccaacctccaccacaccctacctatccatattcccacatcctggaacagatgagcataagtaaaagagataatgtacacctgttttctcatctttatctaatctcacagtctcatgaccagcctgctatcatgtaaccttattccatttctcagatgttttatcactctagctctgagtctatgttcataaaagtctattcctcagggccatgcttcttcctgattcatttatttataaattaatttaaaaacatatttttaaaatttgtatttttaatttttgtgggtacatatcatagatatatatatttatgggtacatgagatgttttgatacaagcatgcaatgtgaaataagcacatcatggagaatggggtatccatcccctcaagcatctatcctttgagttacaaacaatccaaatgcactcttagttattttaaaatgtataattattactgactatcttcactctgttatgctatcaaatactaggtcttattcattctttctattttttgtacccattaaccatcccacctccccccagtcccccactaccattcccagcttctggtaaccatcattctatcttcacctatgctatattttgtatgttctagaaaatacagagagctagtcttgctcttttgctgttcacatgtgtacatatatatatagagtcagaaataatagctaaagagatatgggatatattggtacaatttcttcctcatcagctttcacactttacttttgcatctgagactttgcatggtcatatgtgtgtgtaggcaaaaatacagtttgaggtgtttatcagtatgagtgtgtattcactcttcatcttgtcatactttcacctttcctgcatctctccatactagcttgccatgagctctttctccatccctcctggtatttttcacagcctaaccatgatataacttaccttagtctcaaaatctctacaaaacatcccttggcatattcttggggtacaccatttattatgccaataggagatatttatactgttcttgtagccccacttcccctgggatgggtaccatagtatcttggaggcgttgatgtagtatagttaatagactctggagaattcctcttctcaatctcttcctccttatactgaaacaatatggcaagagtttatcattgttctcttgtttttcccaaattttatattcatttactgacactgacagaatatgtttaatttctcacttcaaaattaaattgccaaactcttggtaaacacttgggattttgtctttattcttctatcacatcttcttcagttagttccctgactctctcttcttcaaatttctctttctagtcctaataaaatattttattttctcattttaaaacccccttgatagaatttttcatgaaatcaatatctcatcatctattccattgtacttttctttatcaattcatccaccaatggacatttgatggcaactctctggaaatctcttctacagtgtgcatatctatttgacaccactcaaagcttagtctttgtgaacaagatttttgttgggctatgagtcaaatacaatcagcagaaattgtttaacatcacagatttctgaagcaggaataacagtgggaactaacaaaaggctatccgaaaaatttaaaagaaaaaattggggaatgaattgatcataggggatttttcaaagctctgaaatgttcctgagaagctaaaacacaccacatgcgtacatgattatgaaaatatccagaaaagacttgagaaggccctaatctgtcatctctggtaaaataatattaaaatatagaatgcaagttatactacaagaaaatgcctagtacattcaagatgtcatacagacacacatacatagac

SEQ ID NO: 36 - DNA, 11674 bp, Homo sapiens
acacataccaaatgataaatataaataacatttgaaatcaacaataaaatccaaccccactaacttatttatctgtaagttaaatgcacagttgaaaataactgatgacttaaaataagcaatgaaaaagaaattagaatacatttttgtgtaaatttagggagtaaaaatgcagttttgatacatagatatattacatggtgaaatctgggcttttagtgtaactatcacccaaatagtgcacattgtacccattaagtaatttctcattccttaccccccttccactctcctatcctttcaagtctccaatgtctattattccacactctatgccatgtgtagacattatttatgtcccacttacaaatgagaatatgcagcatttgacttgctgtttctgagttagtcccttaaaataaggacctctagtttcatctgtgttgctacaaaagatgtgatatcattctttttgtggctgcatagtattccatggtttacatatacataccactttttctttattcaatcatccaatgatggacacttaggtcaattccatatctgtgctgttgtacacagtgctgagttaaaaatacaagtgcaaatatcttttaaatgtaagaaattcttttcctttgggtatatacccagtattgggattgctgagtcaaatagtagttctattttcagtttttgagaaatctccatacagttttccatagaggttgtgctaatttacattcccaccaacattgcgcaagtgttatcttttctctgcatgcttgccaacatcagttattttttggctttttaaatactaactactctgactggtgtggcatggtatctcattgtggttttaatttgcatttctctgatgttaaacattttttatatgcttgttggctatttgtatgtcttcttttaaaaaatatctgtcatgttctttgcccaccttttagtggtgttacttggtttttgggttgttgctgttggattgtttgagttccatgtatatcctggatattagtcccttgtcagatgcatagttcacaaatattttctccctttcttagggttgtctgtttgctctgttgattatttcttttgctctgcagaagctttttaactgcaattaagtcccatttatctacttttggttttactgcatttgcttctgaggtcttagttatgaattcttcgcttaggccaatgtccagaaaagttttcttaggttttcttctagaatttttataacttcaggtcttaaatttaagtatgtaatgtaacttgagtaaatttttatatacagtgagcgatagtgatcaaattgcattcttctgtatgtggcaatccagttttcccagcaccatttacgaagaaagtgtcctttcttcaaggtatgttcttgtcaactttgtcaaagatcatttggctggaggtatgtgtctttatgcctgggtcctctgttctttttcactaatctatgtctttttttatatcagtatcatgctgttttggttactatagctttgtagtataatttgaagccaagtaatgtgatgcctgcaactttcttcttttcatttaggattgctttgtctatatgagctttttttggttccatatgaatattaggattttcttttctaattctgtgaaaaaaagatgttggtactttgattggaattgcattgaatctgtagattgctttgggcagtgcagtcattttaacaatattaattcttctaatctatgaacataggattatttttccatttgtttgtgtcatctgtaacttacttcatcagtgctttgtagtttttcttgtaaggatctttcatctccttggtttaatatactcctaagtgtttgttaagctattgtaagtggaactgactttgtgatttagttctcagcttgaatgttattggtgtataggaatgctactaatctttgctatcttttatttaaaaaaaaacttttattttagatacagaatgcacattgttacctgggtatattggacccaggtagtaagcatagtactcaataggtagtttttcagctgatgaccccctccttccctcctccctctagtagtcctctgtgtctgttgttcccatgttcatgagcatgtctgctcagtgttcagctctcacatgtgagaacatgcagtatttggttttctgttcctacattaatttccttaggataatggcctccagctccatccatgttgatttcattcatatgatttcattctttttatggttgcttagtattccgtagtttatatgtaacacattttctttatccactccaccactgatgggcacttaggttgattctatgtctttgctattgtgaacagcacagtgatgaacatatgagtgtttgtgtatttttggtataatgagctatattcctttgggtatatatccagtagtaggaccaccaggttaaatggtagctctgtttgaagaaaactatctctctttgcagatgatatgattctatacatagaaaacccttaaggttctgacaaaagggtgctagaactgagaacccattttatcagggttccaggatataaaatccatatacaaaaatcagtagcatttctatataaaaataatgttcagactgagaatcaaatcaagaacacaatcccaattacaatagccacaaacaaaatgaaatacctaggaatacagttaaccaaggaggtggaagatgtctacaataggaattacaaaacagcatggaagaaaatcagaagcaaaacaaatcaatgaaaaaagatcctatgctctcatgctagattggaaaaatggattggaaaaatcaatatcatcaaaatgaccctactgcccaaagcaatttatagattcaacattattcctatcaaaatacaaatggcatttctcatagaattagaaaactattctaaaattcatatggaatcaaaaatgaacccaaatagacaaaccaatcttaagcaataagaacaaaactggaggtgtcacaccacttcaaactatactatgaggctacagtaatcaaaacagcatggcactggtataaagcagatacaaaggacaacggaacaaactagaaaactcagaaataaagctgccatgtacaaccacctgatttttgacagggccaacaaaatgaggagtggggaaagaattccttattcaataaatggtgctcagatacctagtttgtatttatttccataagtagaggaataaaactagatccttacctttcactgtgtgtaaaaattaactcaagatgaattaaagattcatggtaagacctcaaaccataaaagttctagacaaaaagctagaaaatactcttctcaacattggccttggcaaagaatttttgggtaagtcccaaaaagctattgcaacaaaaataaaaattgacaagtgggacctaattaaaataaaaaatttctgcacagcaaaagaaactatcaacagagcaaacagacaacctaaggaaagggagaaaatctctgaaaactaagcatctgatgaaagtctagtatccagattccacaggaaatttaaacaaatcaataagtaacaaataatcccattaaaaaatgggcagaggacataaacagacacttcgcaaaagaaggcataaaagagacaaacaaacatatgaaaaatgctcagcatcaccaatcatcagagaaaacaaatcaaaaccacaatgagataccatctcataccagtcaaaatggctattattaaaaaatcaaaaacctggagaggcttcagagaaaacggaatgcttatacactgttggtgagaatgtaaattatttcaggcactgtggaaagatttcccaaggagctcctggtttttgaacattcattttctatcctgaaaccttactgaatttatttatcaaatctaagagtattttggaggagtcattaaaattttctaaacataacattatattattagcaaacagagaatttgacttcctcttttccaattttgatgccttttatttctttctcttgcctgtttgctctgaatagtgctttcagtagtgtgttgaaaggaagactaaaagtgggcatcttgtcttgttctggtttgtagggagaatgttttcaacttttacccattcaatatgatattggctgagtttgttatatatggatcttactatttggagaaaggttcctgcaatgcctattttgttgaaagtttttatcttgaagggacgctgaattttatgtaatattctctacatctattgagatgatcatgttttttgtttttaattctccttatatggtgaatcacatttattgatttgtgtatcttgagccatccttgcgtccctggaataaaatctagaaaaagtcttgcctatcactatttagaaagtgctggttcaatcaatacattcaaactgatatatccaattattcaatccatactggtaaattaaattgccttctatcatttcctttctatgaacatataaacacaaacacatacacatttttaaatgattaaaactatttatccagacacaggaagacaaagcaaacccaggaaagatacagaaacaacagaaaaatgaatatatattttgtttatctgggagatttctctgaaagtgattgtaaaagaatacgtatctaccatttcactcttataatccttttaaatttcatccagaatatctcactttctctctacccatattccttggtgctgcttctctcctccctagttgctcctactccctcagtcctgagccctacctaaatttttccggccctaccttgtctactgagatgtctttagaatacactcaactgtcttgccatggccagagaatcttctccaagaaagaaaccatcaagtacttccacagccttccatcctacattctaccagtaaacacctgcccagttgcagggctgtgaccctgaggaggaaagatttatacgacaagtagaacctcgcctgaagccaagagagggagatcctccatgtcatcactctctggaatctcccataagaaaatggtagactctggtcctaaacccttaatttccacagagcgcattctgctcctatctgttcacccagtgattgacctaagggctgctttctataggagatcattgaatcacagctaaatttaagtgtctttgctttatagtctgcacatgccacttgttgtggtctactgcctaatcctatatcttaactgtataaatggcaggcagagcagcaataaagaacttacattcaaggtgttcttcctgcaattatcttcctccaagttttttaagggattataaatttcattatgaatgaaactgctaatagccacacaatttccaaatctcctgaagaaaaaaaaaatatgtctcaacactactttagaaacaacttattatttcttttttctcaaagtatataagtacttaaagacaatacactgtgtcttcgaatgttcctacagctcataaacccacacatgaaacatagtagaagtatgcacacgcacacgcacatatattcatatatgtaaaaatatattatgtaaatattatttaaataattaaacaagcaaatgaatgaaatatttacgaatgtatatgtcatgctcatgctgcattatttcctttttcctttaatatctaattttatgactatgcttgcatctctaggtgcatgagggaaattatagtaactattgaataagattatggtgggcatgatatgagtatattcatgtgtggtatacctgtcaatacccatatatctacactgcatctatggtatgttaatattattactagagtaagctattattattattttaagaattctagaagccacttattctgtttattatctttttaaagtaagaattttattccgtattctgttatttcttaaacatactaaagaaaactataaggcagtctatttggcttaaattactacttcctattaaacatgtagtttgagtaaatcactcaacttttccgaacataagtatattaatcacaagaatggaaaaactaatacatactttataaaactgccttgaggatccagcaatagaaataaaagaacttggaaaaggagagttcgacaagggtaaaattctcattattataattaaagtcaaaagcttcagttaacagataaataatgttattggctgcagcattcccttctgtttttctgctttctattaggttagagtgacagactctccaacctccaactggttagtgattggtcttgagaaaaatcctcagcactctctctcgaatctgctttgtcctgactccatagattacaggattgagggctggtgggacaaccacatacaggttggctaatataatatgtatatactgtgggatattatggccaaaacgatgtgtcaagaatgaaaaaaatgctggtgtaaaaaaggctaagataacaccaatatgagaaccacaggtgttgagagctttgagtcgagcttcccaggagggcaggcagaagacagcatacaggatcctgacataggagagaataataaggataacatccagtaacaagagagatatgttgccaaggccaaacctaatgttgactttgatgctggcacaggccagacgggcaatgcccatgtgctcacaataagtatgagggatgatacgatgcccacagaagggcagcctcagaaggagaaacaccagtggaacaaccatgtacaggctcctcaggacagcaatgcctgcaatgaggctgatgattttgctggtgaggatcatggtgtaccgaagaggtttgcaaatggcaatgtagcggtcaaaggccatggccaccaacacaatgctctccatagcagtgaagaaatggatgaagaacatgtgagaaaggcagcctccaaaagatatttctttggtattgaaccagaagatgcccaacattttggggatggtggctgtagacaagcccaggtcaatggaatccaacatggccaggaagtagtacataggctcatggagactctgctcagtctggatcacaaacaagagagcagtgtttcccaggagtgcaacaagatacacaaagaaaaaagggactccaatccaaatgtgcacatcttctagccctgggatacccagcagtaggaatgaagaaggatggaactgggtgtgattagacgtagacattcttcctgccatataaagctgctgggcacaccagcgacgattataatattcctattagtaattcttgttccacttcttcttttgttcagatttctagtcaaattcacaataacatattaatctttctttatatatattcatgagtaaggtaaaatactctccacaatttctcctagcctctcctgagcaacattggtaccaggaatagaaccagtcttattctactgccccttcacctaatatcaaagactaatataaaaagaaatggcagaagaatgtcatctgccaaataaaaatgcaaaatctggaatttagccagaactaaatgagaaaaataaagttccagggtcagtgtctatagaaatgttacacatatttttgcttcacgatcaaggtatttgtaatctcaactattcctctatttgggaatcaaaaatgtagtgtgtaaaaccgtttctgtgttgttatgcatttttacaggtatttgtgactactagactgtatacttctatatacaatttagactatactgtatacaatttgggactactagactgtatacttctgtatacaatttaggctgtatatactgtatacagtttgtgactactagactgtatacttctgtatacaatttagactgtgtatactgtatacaatttgtgactactagactgtatacttctgagagaagaaacaatttatcttgctcatatgcaggaaaaagatctgctacataatagttctcaatttaaaacctccacaaatagacattgattacaaggaggcaaaactgtgggtaattttaatgtcatattttaggaaataaataatttagtttccatcacacctgtgtttgagaaaagaagcttatccatcggatttggaaaatgggtaaaaacaaggaaaagaaaatacttgacaaagagtattttgcagctatgatggaacatggatgaagagataattttaatctagataatcctattatttggagagtgcataaatacacgcattcagtaaagaaactgtttatatataggccagctttttctgtggcaaggaaactaaatattctgggctacaaaattttcaaatatatctcagtcttatattcatgggaagaaagtagaagccctttggatgacctacagtttagctgctactcaaattctatcccagctgttttgtctctatggatgtctccaatatagtaaatcctgaatttacagatagtaaatcctgaatttacggatagtaaatcctgaatttacagatagtaaattcaaaatttgaagcaaaaagttcattactgcgcaacttacttttacttgggaaaaactagttttacagataatgcggaattggttaaatgtgacgtggcaactacacaaaaagcattgattacaatttaagaatacttgaacattgggggaagtcagaattgagacgtacgcagcagagataaaagtgtgtgaatgtcagcaagttctactttaatcctgtaacaacaaaaatgcattgctggtagtacctatttgaagcatacgaagaatagcaaaaatgagagattatttgataatttgggaaattatttcagagagagagagagagagagaatgtgtgtgtataaacttgggtgaaactatcagagataagggtataaacttcctgtttttcactaattgagaatacacaaaataggcagcgaaatacctttcacaatttatcccatcaaatattgaagaggttctctatgtatcagtggtaattaggaagtttaaatacaaaaaatgaataaaactggtcatatatccttaaggaaatcaccacgtagtaaagaagataaaattccaaacatgaaatttaagaactgtactgcaagtgctatggtagaaatgtgcacaggatgttttaaatgtagaggtgagtcaagaaaaattgtatagaggaagttaggcttatgctgacttacagagaaattcttctgacaaaaaagaaagaaaattttattctgtataaataagcaggggcaaagtgggaaaaaaagcacagtggccacttaggatataaaaatgaaatcagtcatcctcttcaatggtcttatccagagattcttattaagtctgatgtcttggtcatgtttaggggctccatacagcatgaactgaaaaaataaaaatatggctacattccaaggatagcaacttatcccatgtatctctgtggattttaaaagaagatttggaaattaatgcttcccttctccctaggacaacatcatttccaagtttataaatactgatcaaagcaaccaatcaattaattatccaataaatgtttacttaaccattatttcaacacatatttacatatcttccaatctctgctggatttaaaaataaaattggttctcagcccctgttttgactccctaactctaaggtcctacatggaattatatccagctatccagcagccacgtcctcagtgtgtcatcttcttaatctaccctattgcaccaacctccaccacaccctacctatccatattcccacatcctggaacagatgagcataagtaaaagagataatgtacacctgttttctcatctttatctaatctcacagtctcatgaccagcctgctatcatgtaaccttattccatttctcagatgttttatcactctagctctgagtctatgttcataaaagtctattcctcagggccatgcttcttcctgattcatttatttataaattaatttaaaaacatatttttaaaatttgtatttttaatttttgtgggtacatatcatagatatatatatttatgggtacatgagatgttttgatacaagcatgcaatgtgaaataagcacatcatggagaatggggtatccatcccctcaagcatctatcctttgagttacaaacaatccaaatgcactcttagttattttaaaatgtataattattactgactatcttcactctgttatgctatcaaatactaggtcttattcattctttctattttttgtacccattaaccatcccacctccccccagtcccccactaccattcccagcttctggtaaccatcattctatcttcacctatgctatattttgtatgttctagaaaatacagagagctagtcttgctcttttgctgttcacatgtgtacatatatatatagagtcagaaataatagctaaagagatatgggatatattggtacaatttcttcctcatcagctttcacactttacttttgcatctgagactttgcatggtcatatgtgtgtgtaggcaaaaatacagtttgaggtgtttatcagtatgagtgtgtattcactcttcatcttgtcatactttcacctttcctgcatctctccatactagcttgccatgagctctttctccatccctcctggtatttttcacagcctaaccatgatataacttaccttagtctcaaaatctctacaaaacatcccttggcatattcttggggtacaccatttattatgccaataggagatatttatactgttcttgtagccccacttcccctgggatgggtaccatagtatcttggaggcgttgatgtagtatagttaatagactctggagaattcctcttctcaatctcttcctccttatactgaaacaatatggcaagagtttatcattgttctcttgtttttcccaaattttatattcatttactgacactgacagaatatgtttaatttctcacttcaaaattaaattgccaaactcttggtaaacacttgggattttgtctttattcttctatcacatcttcttcagttagttccctgactctctcttcttcaaatttctctttctagtcctaataaaatattttattttctcattttaaaacccccttgatagaatttttcatgaaatcaatatctcatcatctattccattgtacttttctttatcaattcatccaccaatggacatttgatggcaactctctggaaatctcttctacagtgtgcatatctatttgacaccactcaaagcttagtctttgtgaacaagatttttgttgggctatgagtcaaatacaatcagcagaaattgtttaacatcacagatttctgaagcaggaataacagtgggaactaacaaaaggctatccgaaaaatttaaaagaaaaaattggggaatgaattgatcataggggatttttcaaagctctgaaatgttcctgagaagctaaaacacaccacatgcgtacatgattatgaaaatatccagaaaagacttgagaaggccctaatctgtcatctctggtaaaataatattaaaatatagaatgcaagttatactacaagaaaatgcctagtacattcaagatgtcatacagacacacatacatagac

SEQ ID NO: 37 - DNA, 2661 bp, Homo sapiens
acaccaggtcctcttaaaaaaaaaaagcattcattaaatgcaattttctgagaagtggactatgtacttttgcctatcattgagtctgatatactattcatttttaagacctaccgaacaggcaaaaaatatgttgccaattaaaatgtgagcaatattttctcatctcttagaattcctattttatgcttactaggagcactttttcaggcttatgtagacatagatgttgtttatggagagcatcgatgtagagtgagatgcacagacggccgtgcacggtgggaggagctttgcccagtgctggtgctcaggaaacccaagcacctgtggaagtagacagcacatccatcccgggacagccccccagagccatctcccagttgatgccccctcactcttggaagcaactgctcttttgattccaatcaccatacattacatttttttaaaaacaaggcatccctctgttgcccaggttggagtgcagtggtgtgatcacagctcactgcagccttggttacccaggctcaagtgatcttcccatctcagcctccagagtagctggaactacacgagggcgccaccacacacagtgaatttttgtgtttttttgcagtcacggggttttgctatgttgcccaggctgacatcaaacccctgggcttatgcgatcctcctgccttgacctcccaaagggctgggattacaggtgtgagctgctgtgcccagcctacattactttggtctgttctggagtttcatgtaaatggaatcaagcataagtacccctttgttcctgtctttttttcgatccagtaatggttttgagcttcatcctcactgcgtgcattacccattcattctctgcaatttacatgcatgattgtagactgtatgcagataccacagcttatttctgcattttcaaattaatggatattttgtttttctctttaggttggggctactacaaataaagataccaggtactagtcattgtactagtcattcgtgagtgcatgttttcatgatgctggggataaatacctgagagtaggtttccagagtagccccagcatttcacactcacaggaggaatgtccgaggcctcccactgctcctcagctcagctggcctgtggggtggggtttctggtttgggttgttctagcaggcatgtggtgctgcctcatggtgatgttttacctgcattgtcatgatgacggatgatgttggacagtttctttcaaatacttatttttcagtcacacatctttcattttgtcatgtctgttttcacctttgttaaatttggataaggctgttcacctttggtgttgatttgcagacgttgtttatagcacctggagtctttgtcagctgtgtatattagggatctcttctcccagtctgtggcttgccttttcgttttcttaatggtctcttttggtgaggtaagttctaaattttaatgaagtccacttttttttgtcttttgtgcttagtgctttctgcatctgccctagagatctttgtctaacccaatatctcaataatagtctccatattttcttttagagtctttatatttttagcttttatgtttagatctctaatttatctcaaataaatttgtgtgtgtggtgagttaggcttttccatctttaactgtcatgtagatatctcattgttgtagaattatttgttgagaaggcttccctttcttattgaattgttttggtgcctcatcaaatatcaattgaacatatacatatatttttaaatttacttataagctttttattcttttccagtcatctacttagctgtcctttttccactaacatctagtctagattactggctttataatgatttttcaagtaaggtaatattagtcccccagtgtggctctttcggaagaaaactttgaataagttaggtccttcacattttcctatttgttttagaaccataatgtcagtttctactatagagcttcctaggatttcggtaggaattatatgggatccaccaatcaaactggggggaattaaagcatttctgagtctgctcatccattaacatggtacatctctttatttatttaggtgttctaattttttcagcaatgcttttagttttcaatgtattgtacatctttgataaaattctttctaagcacttttatgtttttgatattatagcaaatgacatttaatttttttaatattccaattattcattagtaatatataaaaatagaagtagtttttgtagattgagcttgtacttaggactttgtcattttcacttattaattttagcagcttttgctttgcaaatataaaaaagtagtgagattattactaatctaaaagtgaaagtgttcagtcttttgtcattaaatatgatgttagctatagacttttcaaatatgctctttatcagacagagaaggcttttctctacacctagtctaccaagagttttgctatttaattattgaagtacttaatcttaataaaaatgagcaactaaatttacttgtctaaagactgatagttttgctatagctgaaaacatttgcatttagggtataatgctattgcaatgtctaaaagaattgttggttatgatttgtagtattttaaatagt

SEQ ID NO: 38 - DNA, 10435 bp, Homo sapiens
acaccaggtcctcttaaaaaaaaaaagcattcattaaatgcaattttctgagaagtggactatgtacttttgcctatcattgagtctgatatactattcatttttaagacctaccgaacaggcaaaaaatatgttgccaattaaaatgtgagcaatattttctcatctcttagaattcctattttatgcttactaggagcactttttcaggcttatgtagacatagatgttgtttatggagagcatcgatgtagagtgagatgcacagacggccgtgcacggtgggaggagctttgcccagtgctggtgctcaggaaacccaagcacctgtggaagtagacagcacatccatcccgggacagccccccagagccatctcccagttgatgccccctcactcttggaagcaactgctcttttgattccaatcaccatacattacatttttttaaaaacaaggcatccctctgttgcccaggttggagtgcagtggtgtgatcacagctcactgcagccttggttacccaggctcaagtgatcttcccatctcagcctccagagtagctggaactacacgagggcgccaccacacacagtgaatttttgtgtttttttgcagtcacggggttttgctatgttgcccaggctgacatcaaacccctgggcttatgcgatcctcctgccttgacctcccaaagggctgggattacaggtgtgagctgctgtgcccagcctacattactttggtctgttctggagtttcatgtaaatggaatcaagcataagtacccctttgttcctgtctttttttcgatccagtaatggttttgagcttcatcctcactgcgtgcattacccattcattctctgcaatttacatgcatgattgtagactgtatgcagataccacagcttatttctgcattttcaaattaatggatattttgtttttctctttaggttggggctactacaaataaagataccaggtactagtcattgtactagtcattcgtgagtgcatgttttcatgatgctggggataaatacctgagagtaggtttccagagtagccccagcatttcacactcacaggaggaatgtccgaggcctcccactgctcctcagctcagctggcctgtggggtggggtttctggtttgggttgttctagcaggcatgtggtgctgcctcatggtgatgttttacctgcattgtcatgatgacggatgatgttggacagtttctttcaaatacttatttttcagtcacacatctttcattttgtcatgtctgttttcacctttgttaaatttggataaggctgttcacctttggtgttgatttgcagacgttgtttatagcacctggagtctttgtcagctgtgtatattagggatctcttctcccagtctgtggcttgccttttcgttttcttaatggtctcttttggtgaggtaagttctaaattttaatgaagtccacttttttttgtcttttgtgcttagtgctttctgcatctgccctagagatctttgtctaacccaatatctcaataatagtctccatattttcttttagagtctttatatttttagcttttatgtttagatctctaatttatctcaaataaatttgtgtgtgtggtgagttaggcttttccatctttaactgtcatgtagatatctcattgttgtagaattatttgttgagaaggcttccctttcttattgaattgttttggtgcctcatcaaatatcaattgaacatatacatatatttttaaatttacttataagctttttattcttttccagtcatctacttagctgtcctttttccactaacatctagtctagattactggctttataatgatttttcaagtaaggtaatattagtcccccagtgtggctctttcggaagaaaactttgaataagttaggtccttcacattttcctatttgttttagaaccataatgtcagtttctactatagagcttcctaggatttcggtaggaattatatgggatccaccaatcaaactggggggaattaaagcatttctgagtctgctcatccattaacatggtacatctctttatttatttaggtgttctaattttttcagcaatgcttttagttttcaatgtattgtacatctttgataaaattctttctaagcacttttatgtttttgatattatagcaaatgacatttaatttttttaatattccaattattcattagtaatatataaaaatagaagtagtttttgtagattgagcttgtacttaggactttgtcattttcacttattaattttagcagcttttgctttgcaaatataaaaaagtagtgagattattactaatctaaaagtgaaagtgttcagtcttttgtcattaaatatgatgttagctatagacttttcaaatatgctctttatcagacagagaaggcttttctctacacctagtctaccaagagttttgctatttaattattgaagtacttaatcttaataaaaatgagcaactaaatttacttgtctaaagactgatagttttgctatagctgaaaacatttgcatttagggtataatgctattgcaatgtctaaaagaattgttggttatgatttgtagtattttaaatagtcccttcaattttgcaaaatgctttatctttctttctaaatacactcatatattcttccactaactcctcccgcccaccttgtgagacaattagacaggtttgacactgttgtgaacccaaagtatctgtgacaagtctcagtcaatttggaaagtttattttgccaagggtatggatgtacccatgacatggcctcgggaggtcctaacgacgcgtgcccaaggtggtcggggcacagcttggtttcatgtgtgagacatcaatcagtatgtgtaagaagtacattggttcagtccagaaaggcgggacaacttcttaagcagatatgagacaaatggttgcattcttttgagtctctgatgagcctttcactgaatatacaacgtacatctgagaggaggatagaggaacagtcgcttccgccctagtctggctcagtgaagcaatagggtggaggaagccatcagatctgcacctgtctcaggtgagctgctgagggatgactgagttctgtctgtccttggtccatgggaatttcctgcaggcaaacagcgagggaggtctgtagcttttttacctttgtagccctcttattcaggaataaactgaggggcaggtttgccgaacacagttcctggcttgacttccctttggcttcgtgactttggggtcctgagatttcctttcctttcacaccgtcttagtctgtttgggctgccgtaacaaaatcccttccactgggtggcttataaacaacagaaattcatttctcatagctctggaggctggaagtccaagatccaggcactggcagatttggtgtcggggtgaggggtgaggggtgggggtgattcatgttctggttcgtaaacggtgtccttttgtttcctcacatggtgaaaggaacaaaccagatccctggagctccctcacccttttttttgttttgtttttttgagatggagtctcgctctgtcacccaggctggagtacagtggcatgatctcggctcactgtaacctctgcctcacgggttcaagcaattctcctgtctcggccccctgagtagctgggactacaggtgcacaccaccacacccagctaatttttgtatttttagtagagacagggtttcaccatatttgtcaggcttgtcttgaactcctgacttcaggtgatccacccaccttggcctcccaaagtgctgagactacaggcgtgagccactgcacccagctggagccccttttctaaaggctcatctcattcccagccggagcctcttttctaaaggctcatctcattcctgagggctccaaggccccacccccaaatgccatcagctttggagaaaagatttcaacacaggaattttgagggggcacaaacatttgaccagtgcagattctgtgtgacaagtgattcccagcatttacattacaggattgaagcggagtggccaggttggggctgaactgagacttaaccgtatttattctcttcttgttttattttctccattttgcactgtgcaacctgccatatttttggaatgactactacagacttaaatacaaactctttgactttgaacattaaatttgcttaacatagaagtaaatactggttaggtgtgttggctcacgcctgtaatctcagaactttgggaggtcaggggcggatcacttgaggccaggagttcgagaccagcctggccaacatctctactaaaaaaatacaaaaaattaattgggcgtggtggtgtgtccctgtagtctcagctctgaaggctgaagcaagagaatcacttgaaccggggaggtggaggttgcagtgagttgagatcgtgccactgcactccagcctgcatgacagagggagaattcgtctcaaaaaaaaaaaaaaaaaaaaggagtaaataagaagatgggagtaaacagaaaatagcacccaccagcctaaactagacgtgaattatgtcattatgatgttcatttctttaatagttaagaccccttagggtaatgtgtgggcatactgtcaatacttgtaataattcctgaagaactcttaaggtgttggctgacactaaataacaatgttatgcatttctttaaaaacaaggtatgtctggggcagcatagtgttcccagagcagactggatgtggagaaaagggattcagagttccttgacaacaacagcaatgacatccattcaaccacgcagctgccagcaatgggctcaacagccacaaaacagatcagcagcagagctgtgtggcacactcagggccaggggaggcctccaggccagtgcacatatagctcagggaaacatggaaaagctggaagctggaactgggcagagggaacctgtgggttctgtctctgtggcattagtttagggagaagccagcctggtggtggtcaggtgtggcattagtttagggggcagccggtctggtggtggtcaggtgtggcattagtttagggggcagccggcctggtggtggtcaggtgtggcattagtttagggggcagccggcctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccggtctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccccagcctggtggtggtcaggtgtggcattagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtggtgtcagattgacactttcaagtacttctggttttcaggagcttcgcgggaccatgtgcctgctggaagctgagcaagaactctccaaatgttgatgcaaagcccctaagcgtgtgagcttgccaaaaaacttaaaacctgcagcgtgcgatgtcttgaaatatggccaaatatggagacttcatttttagaatgcatgtgattcgttcttgctttctataaaaatgctttaggcgtcgtcatactgaatcaagtagacttcatttaatgaaataattatttaagagtttttttaatgttcataaatgtctggcagctgcttattatcatctaaaaactcctcttggttgtcagattatttgaacaaactgtcagacacattataagtcacaagcatctaatgctagtttgggaaacgaactcatatttttttaatagaccttctaccaactttacaaaggtagctttctacaaattaaaaaaaagttgttacatggttataaaacttaaaatttatagaagtaaattggaatgggaatcatgtttctataaaacttaaagtttatagaagtgaaattgaaatcatatttctataaaagttagaatttatagaagtaaattggaattgaaatcatgtttctataaaacaacacttatagaagtaaattggaatgggaatcacattgctagcctaatatttaatgagacaatatggaggaaggctgtctccaatgtgctaattacttttcgggagtgtgttcaggaaggggcacaggcctgcaggccagggatctgagccacagacagcagaaagctgtcagagaagggagcacacaggcaatgctcgtggaactagaaaagcacaaaccaccaaatagaactacctatgaaagacagcaccatgcaatcatagttatactacagaattattacaacatttatactacagaattagtacatttccttatgggttctgagtaccagcagggtgtcactgactctggcaagagcagaaaccttcagattgaggcaaagccaaaggtttgagtgagaatgaacttaatacactaaatggaaggctattctttggttaaaaatgttgtaatgtgggagaataataaattatacatattctatattgttaatataatatataattaatataatactataagtaatataatacatattatatatgtatgcatgtgtgtattaaaagtcagcctcttgaatgccttcatatcggaattgcttctatttgcgtctttttcagattattttttctttatacattaactcctcaaaatttattatatgagaaaatgatgtagttaagggccttctgaataggaaagaaaagtgacatattttcatctaatatattaaaatggaatattgcaatagggattttgtaatcattcattattactttttttctgaattatttccagaatttctagctttatttttctctatcaatggtcatttttggaagcgtagcctactccatctggaatcaaacataacttatagtaatatgattagtttaaaacttgaactttggttccttgtccccacttaacagaaccaagtgtctctgtcttgacatttccaccttggtgtcctgtgtctaccggtccctgtgtggtcctgccggtgactccaccatgatccttggagcagcctctccttccctatttccctagttctctacccttgccatcctgcttctctcaatcttcagtttcactcagttctctttttcctgcgcccttcatgcttcctaaggcctcacgggcatctttctagaggatcgtggagctcctcctcctccctgaggcctcacgggcgtctttctagaggatctctgagctcctcctccttcctgaggcctcacgggcgtctttctagaggatctccaagctcctcctccttcctgaggcctcacgaggggcatctttctagaggatcgcggagctcctcctccttcctgaggcttcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatcgccgagctcctcctccttcctgaggcctcacgggcgtctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgaggggcatctttctagaggatcgccgagctcctcctccttcctgaggcctcacgaggggcatctttctagaggatcgcggagctcctcctccttcctgaggcctcacgggcatctttctagaggatctccgagctcctcctccttcctgaggcctcacgggcatctttctagaggatctccgagctcctcctccttcctgaggcctcgcgggcatctttctagaggatctctgagctcctcctccttcctgaggcctcgcgggcatctttctagaggatctccgagctcctcctccttcctgaggcctcacgagcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatcgccgagctcctcctccttcctgaggcctcacgaggggcatctttctagaggatctccgagctcctcctccttcctgaggcctcacgggcatctttctagaggattgccgagctcctcctccttcctgaggcctcacgaggggcatctttctagaggatctccgagctcctcctccttcctgaggcctcacgggcatctttctagaggatcgccgagctcctcctccttcctgaggcctcacgagcatctttctagaggatggccgagctcctcctccttcctgaggcctcacgggcatctttctagaggatggccgagctcctccttcctaaggcctcacaaggggcatctttctagaggatcgccgagctcctcctccttcctgaggcctcacgaggggcatctttctagaggatctccgagctcctcctccttcctgaggcctcacgggcatctttctagaggatcgccgagctcctcctccttgggttccttcctggagtcacggccccatgcgcctccccaagacggaaatctcccgtgctgtggtgacacaggacctgtcatgtgcgaattcacccctccttgttccctctaccagcgtgattaagtcctttatagaataaggacttgtctcctgccagagagaaccacccccgtcagctctgcctgcagaacgctgcgttctggggtgccccaggagggagtgacagtcacaggtggaaattgtgttctgtggccttctcttcccaggggccgtcatcagtttgtttaaagatcttctgcctccactgtggcccttactaaaagaaaatggaattgcatttctccaatgagtctgaatttcccacatgcagccaggtttatcaggtaaaattgcatgggttaacagccctcatcaaccacgatgtttatataaacatacacgaagtttcttctgactctgctctaatatctttaatattttatatcatgctcatcaaattttaagaggttgatttaatccatcttattttgcttatgataagctttcaaatatcacataaaatcctcaagagagacgtttcaagaatttttgagaac

SEQ ID NO: 39 - DNA, 6095 bp, Homo sapiens
acaccaggtcctcttaaaaaaaaaaagcattcattaaatgcaattttctgagaagtggactatgtacttttgcctatcattgagtctgatatactattcatttttaagacctaccgaacaggcaaaaaatatgttgccaattaaaatgtgagcaatattttctcatctcttagaattcctattttatgcttactaggagcactttttcaggcttatgtagacatagatgttgtttatggagagcatcgatgtagagtgagatgcacagacggccgtgcacggtgggaggagctttgcccagtgctggtgctcaggaaacccaagcacctgtggaagtagacagcacatccatcccgggacagccccccagagccatctcccagttgatgccccctcactcttggaagcaactgctcttttgattccaatcaccatacattacatttttttaaaaacaaggcatccctctgttgcccaggttggagtgcagtggtgtgatcacagctcactgcagccttggttacccaggctcaagtgatcttcccatctcagcctccagagtagctggaactacacgagggcgccaccacacacagtgaatttttgtgtttttttgcagtcacggggttttgctatgttgcccaggctgacatcaaacccctgggcttatgcgatcctcctgccttgacctcccaaagggctgggattacaggtgtgagctgctgtgcccagcctacattactttggtctgttctggagtttcatgtaaatggaatcaagcataagtacccctttgttcctgtctttttttcgatccagtaatggttttgagcttcatcctcactgcgtgcattacccattcattctctgcaatttacatgcatgattgtagactgtatgcagataccacagcttatttctgcattttcaaattaatggatattttgtttttctctttaggttggggctactacaaataaagataccaggtactagtcattgtactagtcattcgtgagtgcatgttttcatgatgctggggataaatacctgagagtaggtttccagagtagccccagcatttcacactcacaggaggaatgtccgaggcctcccactgctcctcagctcagctggcctgtggggtggggtttctggtttgggttgttctagcaggcatgtggtgctgcctcatggtgatgttttacctgcattgtcatgatgacggatgatgttggacagtttctttcaaatacttatttttcagtcacacatctttcattttgtcatgtctgttttcacctttgttaaatttggataaggctgttcacctttggtgttgatttgcagacgttgtttatagcacctggagtctttgtcagctgtgtatattagggatctcttctcccagtctgtggcttgccttttcgttttcttaatggtctcttttggtgaggtaagttctaaattttaatgaagtccacttttttttgtcttttgtgcttagtgctttctgcatctgccctagagatctttgtctaacccaatatctcaataatagtctccatattttcttttagagtctttatatttttagcttttatgtttagatctctaatttatctcaaataaatttgtgtgtgtggtgagttaggcttttccatctttaactgtcatgtagatatctcattgttgtagaattatttgttgagaaggcttccctttcttattgaattgttttggtgcctcatcaaatatcaattgaacatatacatatatttttaaatttacttataagctttttattcttttccagtcatctacttagctgtcctttttccactaacatctagtctagattactggctttataatgatttttcaagtaaggtaatattagtcccccagtgtggctctttcggaagaaaactttgaataagttaggtccttcacattttcctatttgttttagaaccataatgtcagtttctactatagagcttcctaggatttcggtaggaattatatgggatccaccaatcaaactggggggaattaaagcatttctgagtctgctcatccattaacatggtacatctctttatttatttaggtgttctaattttttcagcaatgcttttagttttcaatgtattgtacatctttgataaaattctttctaagcacttttatgtttttgatattatagcaaatgacatttaatttttttaatattccaattattcattagtaatatataaaaatagaagtagtttttgtagattgagcttgtacttaggactttgtcattttcacttattaattttagcagcttttgctttgcaaatataaaaaagtagtgagattattactaatctaaaagtgaaagtgttcagtcttttgtcattaaatatgatgttagctatagacttttcaaatatgctctttatcagacagagaaggcttttctctacacctagtctaccaagagttttgctatttaattattgaagtacttaatcttaataaaaatgagcaactaaatttacttgtctaaagactgatagttttgctatagctgaaaacatttgcatttagggtataatgctattgcaatgtctaaaagaattgttggttatgatttgtagtattttaaatagtcccttcaattttgcaaaatgctttatctttctttctaaatacactcatatattcttccactaactcctcccgcccaccttgtgagacaattagacaggtttgacactgttgtgaacccaaagtatctgtgacaagtctcagtcaatttggaaagtttattttgccaagggtatggatgtacccatgacatggcctcgggaggtcctaacgacgcgtgcccaaggtggtcggggcacagcttggtttcatgtgtgagacatcaatcagtatgtgtaagaagtacattggttcagtccagaaaggcgggacaacttcttaagcagatatgagacaaatggttgcattcttttgagtctctgatgagcctttcactgaatatacaacgtacatctgagaggaggatagaggaacagtcgcttccgccctagtctggctcagtgaagcaatagggtggaggaagccatcagatctgcacctgtctcaggtgagctgctgagggatgactgagttctgtctgtccttggtccatgggaatttcctgcaggcaaacagcgagggaggtctgtagcttttttacctttgtagccctcttattcaggaataaactgaggggcaggtttgccgaacacagttcctggcttgacttccctttggcttcgtgactttggggtcctgagatttcctttcctttcacaccgtcttagtctgtttgggctgccgtaacaaaatcccttccactgggtggcttataaacaacagaaattcatttctcatagctctggaggctggaagtccaagatccaggcactggcagatttggtgtcggggtgaggggtgaggggtgggggtgattcatgttctggttcgtaaacggtgtccttttgtttcctcacatggtgaaaggaacaaaccagatccctggagctccctcacccttttttttgttttgtttttttgagatggagtctcgctctgtcacccaggctggagtacagtggcatgatctcggctcactgtaacctctgcctcacgggttcaagcaattctcctgtctcggccccctgagtagctgggactacaggtgcacaccaccacacccagctaatttttgtatttttagtagagacagggtttcaccatatttgtcaggcttgtcttgaactcctgacttcaggtgatccacccaccttggcctcccaaagtgctgagactacaggcgtgagccactgcacccagctggagccccttttctaaaggctcatctcattcccagccggagcctcttttctaaaggctcatctcattcctgagggctccaaggccccacccccaaatgccatcagctttggagaaaagatttcaacacaggaattttgagggggcacaaacatttgaccagtgcagattctgtgtgacaagtgattcccagcatttacattacaggattgaagcggagtggccaggttggggctgaactgagacttaaccgtatttattctcttcttgttttattttctccattttgcactgtgcaacctgccatatttttggaatgactactacagacttaaatacaaactctttgactttgaacattaaatttgcttaacatagaagtaaatactggttaggtgtgttggctcacgcctgtaatctcagaactttgggaggtcaggggcggatcacttgaggccaggagttcgagaccagcctggccaacatctctactaaaaaaatacaaaaaattaattgggcgtggtggtgtgtccctgtagtctcagctctgaaggctgaagcaagagaatcacttgaaccggggaggtggaggttgcagtgagttgagatcgtgccactgcactccagcctgcatgacagagggagaattcgtctcaaaaaaaaaaaaaaaaaaaaggagtaaataagaagatgggagtaaacagaaaatagcacccaccagcctaaactagacgtgaattatgtcattatgatgttcatttctttaatagttaagaccccttagggtaatgtgtgggcatactgtcaatacttgtaataattcctgaagaactcttaaggtgttggctgacactaaataacaatgttatgcatttctttaaaaacaaggtatgtctggggcagcatagtgttcccagagcagactggatgtggagaaaagggattcagagttccttgacaacaacagcaatgacatccattcaaccacgcagctgccagcaatgggctcaacagccacaaaacagatcagcagcagagctgtgtggcacactcagggccaggggaggcctccaggccagtgcacatatagctcagggaaacatggaaaagctggaagctggaactgggcagagggaacctgtgggttctgtctctgtggcattagtttagggagaagccagcctggtggtggtcaggtgtggcattagtttagggggcagccggtctggtggtggtcaggtgtggcattagtttagggggcagccggcctggtggtggtcaggtgtggcattagtttagggggcagccggcctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccggtctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccccagcctggtggtggtcaggtgtggcattagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtggtgtcagattgacactttcaagtacttctggttttcaggagcttcgcgggaccatgtgcctgctggaagctgagcaagaactctccaaatgttgatgcaaagcccctaagcgtgtgagcttgccaaaaaacttaaaacctgcagcgtg

SEQ ID NO: 40 - DNA, 11881 bp, Homo sapiens
acttaagaaaagttaccattgcttgctttttctcagttcaaaagtaattcatgctagccatagaaaattcaaaaaatacaggtggaaggaaaaaaactaaataacctgcatccaggcagagcagctgaggtggagtcgctgccagtgtggactgaggagcccgtgcctggctcagccctgccctgcctcactccttcctggctccagtgggctcggccctgccctgcctcactccttcccggctccaatgggctcagccctgcctttcctcaccccttcccagctccactgggctcagccctgccctgcctcacccctcctggtctgaagcttaggaaggaatggctgtcatatcggaaactattccttcacagcagatgaacgcacaatgtctgtgtattgggtgtttgcttctcaggcatctgctggcctacaggctctgctgggggttccagactacaggggtgtgggtctgaccccctgtctctcatcttccttgcactaatcagcaaactggggatgttcttctcatagcagcagcagaggcacacgaaagccgggcctcacacacaagcaaatttggagcctcccccgcctcttgctccccaacctcctgctggccatgctgagttcacaggcttgggcccaaagtcccaggtagggaagagcacccagcctctatgggagcactgcagagaccttggcaatacggagagagtggccagtactgcagtctgttcttcctggaataagggtgtcattgtcctgagtgggacaaactgaagaagggaggagggcagaggagggcagaggagggcgagggccttgcagccgctccgtcagggatgaggctgtgcacaggcgaggaaaccaagcatctccaaaagttccaggctgtggttgcaacagtaattgggacttggcagaggccatcggaggtaaacaaactctagtccctacacgtcagagcagcacagcagcaggccagcaaaaactggggagccaggccggccaatagtaacaagacttggggtgggcaaaggaaatggaagcaggcgattaagaagttcacccaggaagctgagatgagagagagaaccacagatggccatgcagggttgcaggtattacagtcggctggacgtgaagaccacctgtgagatagctcctcctgcggactagactcacaccagtgggaatctgagttcttccgacgtgggacctaaactgaattgagacattctggtgggtttattcacactttctaatgaaaacctcctcttgccaataaagtcagcacttcaaggcccacaagtgttcttataaacaaaacgaaacttgcatagataaagccaaacttggcaagagttgggaatgctcaaggcctgtggtttaaatcacattagtggtaagaggtctctgtttaatcgagtgtacactaatggaacaccaggtcctcttaaaaaaaaaaagcattcattaaatgcaattttctgagaagtggactatgtacttttgcctatcattgagtctgatatactattcatttttaagacctaccgaacaggcaaaaaatatgttgccaattaaaatgtgagcaatattttctcatctcttagaattcctattttatgcttactaggagcactttttcaggcttatgtagacatagatgttgtttatggagagcatcgatgtagagtgagatgcacagacggccgtgcacggtgggaggagctttgcccagtgctggtgctcaggaaacccaagcacctgtggaagtagacagcacatccatcccgggacagccccccagagccatctcccagttgatgccccctcactcttggaagcaactgctcttttgattccaatcaccatacattacatttttttaaaaacaaggcatccctctgttgcccaggttggagtgcagtggtgtgatcacagctcactgcagccttggttacccaggctcaagtgatcttcccatctcagcctccagagtagctggaactacacgagggcgccaccacacacagtgaatttttgtgtttttttgcagtcacggggttttgctatgttgcccaggctgacatcaaacccctgggcttatgcgatcctcctgccttgacctcccaaagggctgggattacaggtgtgagctgctgtgcccagcctacattactttggtctgttctggagtttcatgtaaatggaatcaagcataagtacccctttgttcctgtctttttttcgatccagtaatggttttgagcttcatcctcactgcgtgcattacccattcattctctgcaatttacatgcatgattgtagactgtatgcagataccacagcttatttctgcattttcaaattaatggatattttgtttttctctttaggttggggctactacaaataaagataccaggtactagtcattgtactagtcattcgtgagtgcatgttttcatgatgctggggataaatacctgagagtaggtttccagagtagccccagcatttcacactcacaggaggaatgtccgaggcctcccactgctcctcagctcagctggcctgtggggtggggtttctggtttgggttgttctagcaggcatgtggtgctgcctcatggtgatgttttacctgcattgtcatgatgacggatgatgttggacagtttctttcaaatacttatttttcagtcacacatctttcattttgtcatgtctgttttcacctttgttaaatttggataaggctgttcacctttggtgttgatttgcagacgttgtttatagcacctggagtctttgtcagctgtgtatattagggatctcttctcccagtctgtggcttgccttttcgttttcttaatggtctcttttggtgaggtaagttctaaattttaatgaagtccacttttttttgtcttttgtgcttagtgctttctgcatctgccctagagatctttgtctaacccaatatctcaataatagtctccatattttcttttagagtctttatatttttagcttttatgtttagatctctaatttatctcaaataaatttgtgtgtgtggtgagttaggcttttccatctttaactgtcatgtagatatctcattgttgtagaattatttgttgagaaggcttccctttcttattgaattgttttggtgcctcatcaaatatcaattgaacatatacatatatttttaaatttacttataagctttttattcttttccagtcatctacttagctgtcctttttccactaacatctagtctagattactggctttataatgatttttcaagtaaggtaatattagtcccccagtgtggctctttcggaagaaaactttgaataagttaggtccttcacattttcctatttgttttagaaccataatgtcagtttctactatagagcttcctaggatttcggtaggaattatatgggatccaccaatcaaactggggggaattaaagcatttctgagtctgctcatccattaacatggtacatctctttatttatttaggtgttctaattttttcagcaatgcttttagttttcaatgtattgtacatctttgataaaattctttctaagcacttttatgtttttgatattatagcaaatgacatttaatttttttaatattccaattattcattagtaatatataaaaatagaagtagtttttgtagattgagcttgtacttaggactttgtcattttcacttattaattttagcagcttttgctttgcaaatataaaaaagtagtgagattattactaatctaaaagtgaaagtgttcagtcttttgtcattaaatatgatgttagctatagacttttcaaatatgctctttatcagacagagaaggcttttctctacacctagtctaccaagagttttgctatttaattattgaagtacttaatcttaataaaaatgagcaactaaatttacttgtctaaagactgatagttttgctatagctgaaaacatttgcatttagggtataatgctattgcaatgtctaaaagaattgttggttatgatttgtagtattttaaatagtcccttcaattttgcaaaatgctttatctttctttctaaatacactcatatattcttccactaactcctcccgcccaccttgtgagacaattagacaggtttgacactgttgtgaacccaaagtatctgtgacaagtctcagtcaatttggaaagtttattttgccaagggtatggatgtacccatgacatggcctcgggaggtcctaacgacgcgtgcccaaggtggtcggggcacagcttggtttcatgtgtgagacatcaatcagtatgtgtaagaagtacattggttcagtccagaaaggcgggacaacttcttaagcagatatgagacaaatggttgcattcttttgagtctctgatgagcctttcactgaatatacaacgtacatctgagaggaggatagaggaacagtcgcttccgccctagtctggctcagtgaagcaatagggtggaggaagccatcagatctgcacctgtctcaggtgagctgctgagggatgactgagttctgtctgtccttggtccatgggaatttcctgcaggcaaacagcgagggaggtctgtagcttttttacctttgtagccctcttattcaggaataaactgaggggcaggtttgccgaacacagttcctggcttgacttccctttggcttcgtgactttggggtcctgagatttcctttcctttcacaccgtcttagtctgtttgggctgccgtaacaaaatcccttccactgggtggcttataaacaacagaaattcatttctcatagctctggaggctggaagtccaagatccaggcactggcagatttggtgtcggggtgaggggtgaggggtgggggtgattcatgttctggttcgtaaacggtgtccttttgtttcctcacatggtgaaaggaacaaaccagatccctggagctccctcacccttttttttgttttgtttttttgagatggagtctcgctctgtcacccaggctggagtacagtggcatgatctcggctcactgtaacctctgcctcacgggttcaagcaattctcctgtctcggccccctgagtagctgggactacaggtgcacaccaccacacccagctaatttttgtatttttagtagagacagggtttcaccatatttgtcaggcttgtcttgaactcctgacttcaggtgatccacccaccttggcctcccaaagtgctgagactacaggcgtgagccactgcacccagctggagccccttttctaaaggctcatctcattcccagccggagcctcttttctaaaggctcatctcattcctgagggctccaaggccccacccccaaatgccatcagctttggagaaaagatttcaacacaggaattttgagggggcacaaacatttgaccagtgcagattctgtgtgacaagtgattcccagcatttacattacaggattgaagcggagtggccaggttggggctgaactgagacttaaccgtatttattctcttcttgttttattttctccattttgcactgtgcaacctgccatatttttggaatgactactacagacttaaatacaaactctttgactttgaacattaaatttgcttaacatagaagtaaatactggttaggtgtgttggctcacgcctgtaatctcagaactttgggaggtcaggggcggatcacttgaggccaggagttcgagaccagcctggccaacatctctactaaaaaaatacaaaaaattaattgggcgtggtggtgtgtccctgtagtctcagctctgaaggctgaagcaagagaatcacttgaaccggggaggtggaggttgcagtgagttgagatcgtgccactgcactccagcctgcatgacagagggagaattcgtctcaaaaaaaaaaaaaaaaaaaaggagtaaataagaagatgggagtaaacagaaaatagcacccaccagcctaaactagacgtgaattatgtcattatgatgttcatttctttaatagttaagaccccttagggtaatgtgtgggcatactgtcaatacttgtaataattcctgaagaactcttaaggtgttggctgacactaaataacaatgttatgcatttctttaaaaacaaggtatgtctggggcagcatagtgttcccagagcagactggatgtggagaaaagggattcagagttccttgacaacaacagcaatgacatccattcaaccacgcagctgccagcaatgggctcaacagccacaaaacagatcagcagcagagctgtgtggcacactcagggccaggggaggcctccaggccagtgcacatatagctcagggaaacatggaaaagctggaagctggaactgggcagagggaacctgtgggttctgtctctgtggcattagtttagggagaagccagcctggtggtggtcaggtgtggcattagtttagggggcagccggtctggtggtggtcaggtgtggcattagtttagggggcagccggcctggtggtggtcaggtgtggcattagtttagggggcagccggcctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccggtctggtggtggtcaggtgtggcattagtttagggggcagccggcctggtggtggtcaggtgtggcattagtttagggagcagccggtctggtggtggtcaggtgtggcattagtttagggggcagccggtctggtggtggtcaggtgtggcattagtttagggggcagccggcctggtgttggtcaggtgtggcatgagtttagggggcagccccagcctggtggtggtcaggtgtggcattagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtgttggtcaggtgtggcattagtttacggggcagccggtctggtggtggtcaggtgtggcatgagtttagggggcagccggcctggtggtggtcaggtgtggcatgagtttagggggcagccggcctggtggtgtcagattgacactttcaagtacttctggttttcaggagcttcgcgggaccatgtgcctgctggaagctgagcaagaactctccaaatgttgatgcaaagcccctaagcgtgtgagcttgccaaaaaacttaaaacctgcagcgtgcgatgtcttgaaatatggccaaatatggagacttcatttttagaatgcatgtgattcgttcttgctttctataaaaatgctttaggcgtcgtcatactgaatcaagtagacttcatttaatgaaataattatttaagagtttttttaatgttcataaatgtctggcagctgcttattatcatctaaaaactcctcttggttgtcagattatttgaacaaactgtcagacacattataagtcacaagcatctaatgctagtttgggaaacgaactcatatttttttaatagaccttctaccaactttacaaaggtagctttctacaaattaaaaaaaagttgttacatggttataaaacttaaaatttatagaagtaaattggaatgggaatcatgtttctataaaacttaaagtttatagaagtgaaattgaaatcatatttctataaaagttagaatttatagaagtaaattggaattgaaatcatgtttctataaaacaacacttatagaagtaaattggaatgggaatcacattgctagcctaatatttaatgagacaatatggaggaaggctgtctccaatgtgctaattacttttcgggagtgtgttcaggaaggggcacaggcctgcaggccagggatctgagccacagacagcagaaagctgtcagagaagggagcacacaggcaatgctcgtggaactagaaaagcacaaaccaccaaatagaactacctatgaaagacagcaccatgcaatcatagttatactacagaattattacaacatttatactacagaattagtacatttccttatgggttctgagtaccagcagggtgtcactgactctggcaagagcagaaaccttcagattgaggcaaagccaaaggtttgagtgagaatgaacttaatacactaaatggaaggctattctttggttaaaaatgttgtaatgtgggagaataataaattatacatattctatattgttaatataatatataattaatataatactataagtaatataatacatattatatatgtatgcatgtgtgtattaaaagtcagcctcttgaatgccttcatatcggaattgcttctatttgcgtctttttcagattattttttctttatacattaactcctcaaaatttattatatgagaaaatgatgtagttaagggccttctgaataggaaagaaaagtgacatattttcatctaatatattaaaatggaatattgcaatagggattttgtaatcattcattattactttttttctgaattatttccagaatttctagctttatttttctctatcaatggtcatttttggaagcgtagcctactccatctggaatcaaacataacttatagtaatatgattagtttaaaacttgaactttggttccttgtccccacttaacagaaccaagtgtctctgtcttgacatttccaccttggtgtcctgtgtctaccggtccctgtgtggtcctgccggtgactccaccatgatccttggagcagcctctccttccctatttccctagttctctacccttgccatcctgcttctctcaatcttcagtttcactcagttctctttttcctgcgcccttcatgcttcctaaggcctcacgggcatctttctagaggatcgtggagctcctcctcctccctgaggcctcacgggcgtctttctagaggatctctgagctcctcctccttcctgaggcctcacgggcgtctttctagaggatctccaagctcctcctccttcctgaggcctcacgaggggcatctttctagaggatcgcggagctcctcctccttcctgaggcttcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatcgccgagctcctcctccttcctgaggcctcacgggcgtctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatcgctgagctcctcctccttcctgaggcctcacgggcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatctccgagctcctcctccttcctgaggcctcacgaggggcatctttctagaggatcgccgagctcctcctccttcctgaggcctcacgaggggcatctttctagaggatcgcggagctcctcctccttcctgaggcctcacgggcatctttctagaggatctccgagctcctcctccttcctgaggcctcacgggcatctttctagaggatctccgagctcctcctccttcctgaggcctcgcgggcatctttctagaggatctctgagctcctcctccttcctgaggcctcgcgggcatctttctagaggatctccgagctcctcctccttcctgaggcctcacgagcatctttctagaggatggccgagctcctcctccttcctgaggcctcacgggcatctttctagaggatctccgagctcctcctccttcctgaggcctcacgggcatctttctagaggatctccgagctcctcctccttcctgaggcctcacgggcatctttctagaggatcgccgagctcctcctccttcctgaggcctcacgaggggcatctttctagaggatctccgagctcctcctccttcctgaggcctcacgggcatctttctagaggattgccgagctcctcctccttcctgaggcctcacgaggggcatctttctagaggatctccgagctcctcctccttcctgaggcctcacgggcatctttctagaggatcgccgagctcctcctccttcctgaggcctcacgagcatctttctagaggatggccgagctcctcctccttcctgaggcctcacgggcatctttctagaggatggccgagctcctccttcctaaggcctcacaaggggcatctttctagaggatcgccgagctcctcctccttcctgaggcctcacgaggggcatctttctagaggatctccgagctcctcctccttcctgaggcctcacgggcatctttctagaggatcgccgagctcctcctccttgggttccttcctggagtcacggccccatgcgcctccccaagacggaaatctcccgtgctgtggtgacacaggacctgtcatgtgcgaattcacccctccttgttccctctaccagcgtgattaagtcctttatagaataaggacttgtctcctgccagagagaaccacccccgtcagctctgcctgcagaacgctgcgttctggggtgccccaggagggagtgacagtcacaggtggaaattgtgttctgtggccttctcttcccaggggccgtcatcagtttgtttaaagatcttctgcctccactgtggcccttactaaaagaaaatggaattgcatttctccaatgagtctgaatttcccacatgcagccaggtttatcaggtaaaattgcatgggttaacagccctcatcaaccacgatgtttatataaacatacacgaagtttcttctgactctgctctaatatctttaatattttatatcatgctcatcaaattttaagaggttgatttaatccatcttattttgcttatgataagctttcaaatatcacataaaatcctcaagagagacgtttcaagaatttttgagaac

SEQ ID NO: 41 - DNA, 14589 bp, Homo sapiens
aatcacatttctaatagaaattgaatattggaggatttctagtgaacatgtgaggggaagaagatcaaaagatcactttgcactggaaacatttcactgtgtttgtgctgtggttggagatttcagtaagatgggagctgagcagaggcctactgtgtgtcctgtgaggccactgcactggaggcgacctcaggtgtcacttggaatgctgtctcttctcccttagccaaggcaggtcctggagaccttcagagcctgttttctaatgctgtggcaaacaactaaaatgtcgacatttgacctgtgtgctcccaaatggaccataaaaagatgattgcttattttatttagtaataaaagtaatatttttaggccacccctccacaagaaagcttagaaattgcttaagtagctgagaagctggccacagcaggtgtgctggtaagtgtttaacaaccagctctctgggggggaaactatgagtgtgcatctgtgcttatttacctgatataaagaatgtgtaacacacagtttacaaataataataatatattcactcattttttggggggggtgcaggtagaaactcactctgttgcccaggctggagtgcagtggtgcaatcatagctcactgcagccttaaactcctgggctcaagcaatcctcctgccccagcctcccaagtagctgggaccacaggcacgtgacaccatgtctggctaatgttttatgtttttgtagagaaggaggacttgcactgttgccctaactggtcttcaactcctaggctcaaatgatcctgttgcctcagcctcccaaagctctgagtttacaggtgtgagccaccatgccccgcctcactaatctttattgcaaatgccacccacctataacttcagtatgacttggtatttcctgcaaactcacaatcagtttttctaattctgttaccaagaatagtgtcaccaaaccagactacaaataaatgtttgactcctatgtgaatcgccaaagatgttactcataatactggtgaatgaatggagctctgacatgctacactgtgggaggctgtggctctgggtgtggtagagctggttgccatcataaagaaaagctcaagtgaatggggggagagcaggtagaactggaacccatgaggacagagttctgtcctacctgcctcccactgcagtgatgtggggacctgcaggaggagttagtcccactcacacctggcccaggtctcagagatactgagggagaatctggaggagctgccgaccggctgcttctctgagccgctggtgcaagccagcagaccatcgacaacgtgtatgagctgcgacagcccctggtgttgccgggacccacagtgcattttggctgacgcttcctatctgccctccaaatctcacctaaacctctcctgcagtcctcatttggaatcatacagggagggaagtctggaaaacaaagttctagcctagttaagttgacttgatggaacgccaccatgcttgcttgatgcttctgtgctaggtggggatctcctcaccctgttgttccaggtttctttgcctctgcatggaaagctgtttttcaaccatgggacctggaaaactcctgtagtatattcaaaccctgcaaagatctcactcgctctgagaaaagctcccggacccttcccctccaggactagttctgtaccttgtactcaatgactgtgtctactgcacatgctaaatgttcaaggacagagtcactaatggttagaacaactgagccaagctgtgcccatcgcataggtgaagaactggaggagcagagtggttgagtagcttgccaagatcacacagtgacaattggtaggaaagctgtaatttgaacccggtctgtgactcctcttttaattataacccacggtgactagaaagtcaagggagatttggctcctgcccataagaaactccaattagtggaggggaaagaggtggttaaggtagtaagtagctggtcagttgtgctatgtctgagactgacaataggagcagaatgtggagtagaccctggataagggggtccagggtaggaatgaggttgtttcccgccttccgccttccgccttccacttcccgcagcggtagcctcagccttctaggaatggcttctccccagctggaggaagggactagaaggcagcagttatctatgctgcttgccgcgccactgtcacaaagactctggagctagcctgagaactggggtcacagcagtgtgctcagcctacctccagggcctcctgggtctggccagtaggaagatgaggtccgcgttgttgtctgtcagcagctgggatcatacaaaggagcattagcctgggagctagggagtgaggttctagctgcctgctcgctgtgtagtctccagcaagtcctacccctcttggggtctttggtttccttatctggaaaacaaggggcctgggatgggtggccaaggctcctccttccctcaatcgcctgggaatcttggcagttatttggatttggcatttctcatgtaattccaccagagggcgccaaatactagctcttaccaacttggttcctgaagcgggtgtctgctggggagggcgcagaggaggtggagtgtgagttgagtgtgatagtgtggaagcaattagcaattaagtgtatgtgagtgagtgtgtgtgtgtgtgtgtgtgtgtgtgtagcaccaaagctcctgtaaccgcctatatctcccaccaccaccctctgcctgctggctgcatcttcagccacttgaattctcctttcttagcctccacgccctaccagagaggcctggcctcagggcctttgtccttgctgtccctttagcttggaacacgcatccctaaggcatccacagggccctccctcacttcttcttcatgaggcattcctaaccaacctacataaaatagccacccccaaactcattctaagctttagttaaaaacattaaagaaaactgtggtaaaatataccataacataaaaagtactattttaaccattaatttttaaaataagaatatagttaaatacatataacataaaatttcccatcttagctatttttaagtgcatagttcagtagtgtagcgtacattcacattgctgtgcaatcagtctgcagggctctctttttctggcaaaactggagctctgtacctacttaacaataactcttcatttcctccactcctctactttctgtctgtaagaatttgactacatcaggtatctcatgtaagtggaattatacagtatttatcttcttgtgactggcttatttcactcagcataatgtccttccagtagcgataaacccttatgctagcatgtgccagaatttccttcctttttaaggctgaataatatcccactgtgtgcctgtaccatgttgtgttgacccactcatcgatggacactttggttgcttctgtcttttggctgttgtgaataatgctaccataaatagggatgtacaaatacctgtttgaactcctgatttcaattattgttattattattttttgagacaaggtcttagtctgttgcccagcctggattgcagtggcacaatttcaactcactgaagccttgacctcccaagccctaagcaatcctcccaattcagcttcctgagtagctgggactccagacttgcaccaccacgtccagttaattttatttttttttgtggagacagggttttgctatgttgcccagactggtctggaactcctgagctcaaatgatccccctgtcttggcctcccaaagtgctgagatcacaggtgtgagctatcacacctggcccctgctttcaattcttgttccatgcttttatattttattttattttatttattttgagatagggtctcgctctgttgcccaggctggagggcagtgtccatgctttattttttctgcagagcactaattaccaaccaactgccctcctcctgcccacaactagagatgcaaatgatttctatttggtagaaagataaccctaaaggttataattgtattgccttaaggacattagccagttttgttttattttattttattgttgagacggagtctcgctctgtcacccaggctgtagtgcagtggtgcaatctcggctcactgcaacctccgcttcctgggttcaagcgattctcatgcctcagtctcccatgttgctgggattacagatgcccaccactatgcctaatttttgtgtttttggtagaggtggggtttcaccacgttggccaggctggtttcaatctcctgacctcagatgatccacccgcctcggcttcccaaagttctgggattacaggtgtgagccaccatgcccagtcgcaaccggttttacttcaaacctagtaattttattctaacattcttttaaaaatgtctataaatacttaggtcctccaaatactttttggaccagctttaccatcttacttgtttcatcattaatgattaataaatctctgatatgtgttcattccatctttgttatgggagttatgttttttaacttttaaaaaagtatgcattggcatctagaagtttttcccaggggctaaaatctgcttttggatgaaattcagtacatcagtagtttaggacttcgggtgtttgggggcgacctgcactaagccatgcaagtgcgtgcggagcctcttgagttgtggctcccgttggtgtacccagggggtctggaaattccaggaagcttatgaggacctggatctgctgggccccaggaacggccagtacttcctcagcaaccactatgcgccatgcacattctgaaagctttctatgtgttagcttatcctcacacggtctccctgagataaacactagtttgcagatgaggaaacaagctcagagggtttaaggaactctgaggatcacagtttaagcaaaaattatagaagaaagacctaaataaagtggttctatgtgcatcaaggtggttaaatggtttttttctctagttctgcaatttcatctaagatcaaagccaagagggggaagctaaggtatagtctatggtaggagcagccttgcctgtgggggcagaccacacccacacaggcagataccatccatcaggggactgtggtctcctgtgggacagacagacttccagggagcttgctgagaggtgccagttcaaagactagaccctcccaccagctgtcttcccaccgtcatcctggtgatgtgagaggggtgttgtcattggcgggggatgggtgcagaattcaggaaaggagctacttactcgccactccactctgggaggcaagggaatattgacctcgtcaagggaggcgaatcccaagagcatcactgtgaaggctgggggcctgtgccctccacttgcctccccacacactgaactgggtgctggtaacgtcttatctacatgtggccgagggaccggaccagcagaaggtgtggtgctgtgggtggtgagagagataataggaagcaatggctctgggatgggcaggggagagacagccaggggtgcccctcccttcctctgagggtgaggaggatggttgctggatgcttcaggagcttgctggctggggagatggtggctgcaggcggctggggacacaacctgtgtggaagaggtgtgcactttagaggtgtgcacagattggtaccagtctgtggcctgttaggaactgtgccacacagcaggaggcgagcaacaagtgaacaaagcttcatgtgtatttacagccgctcgccgtcgctggctcacattaccgcctgagctccgcctcctgtcagatctgcggcagcattagattctcataggagtgtgaaccctatcgtgaactgtgcatgcgagggatctaggttgcaggctccttatgagaatctaatgcctgatgatctgtcactgtctcccatcagccctagaagggaccattgagttgcaggaaaaccagttcagggctcccactgaattatacagttcaccatagaattgtgaactgtataattatacaattctatggtgaattgtataattatttcattatataacaatcagagaaataaagtgcacaataaatataatgtgcttgaatcatccccctccgtggcacccggtctctggaaagactgtcttccatgaaactggtccctggtgccaaaaaaggtggagactgctgctttagaggactgtggctaaggggtcagctggaagatggggcccagggctcagggaccctgaatgcccggttgctgccaattgtttgtcttcattgatctcctggtcagtggaccagatcagcagaatgaaccagcaaggcgaggactgtgaccttcccaagggcaactcttaatgtaggggaacctctgtgcacctcctacccatgccccttcccataaagggactcaaagaaggagacagggagggagggagggagctgagagcaagtcccgctctcctaggccagtgctcaattccagtctggggatggggaagtagggcagactgatttgaataagagatgtggtttgcaaatcaatggaagaaaaccaggaaggaaaacattataagaaccaaaagagacccaaaagtctaacgctgagttcatccgtgtgcgatgacaagcctgtcccaggtgggtgcaggtgggagttgttggaaagctgagcataagtgcttgaaccctctgtgcccgtttcctcctgtataaaatggagacaatgataatacaggaaaagcttctacctcttagaggtgttgtggggagttaccaagttcatctctgtaggatgcttggcacatggaagttactataaagactagctgccattcttcaaattgtgacttccccagacaccagttcaatgtgctttcttcccacttgattcaatggcagccgtctcggtggtgggacactctgcttgctgtgaggaggatggaggagaaggggctcctcggggccaggccacaggaccctcaggataaggccctgcctccatgttcagggctttcagcagctacagacctgacggggctgcaaaaagctttgcagggaagatgggggaggggtgtatgcaaagaaaaagctgacaagcagtctgctttggaacagggctggacactctgtgttggggagtccagggcccccagcatgcccccggcagcagggagggcatgcctggcaaccttcaaaaagtgaatttccaaagagcaccaggaggaaaccttccagaaccttctcacagaacctttggatgggcctctcagggcgctgttttccaccgtccacttagatcttagtcccttacaaaaaggtacctcccttacgggagatgactgaggtgggggagaattaattcctgttttcctgccctcatggaggatgtcaagtaagaaatccggagaatttctctttctccagttcagtgtgctcaaaggagacccacaggactggaggatcaactgggacaggagaacagagcctttcttgtctaaaaccaagtcagttccacagaataaaagctcatttagagaactcctgggctctgggcgcctatagggtgggtaggagctagtcagtcagtctgttagggaaaagacaaactcatcacatgatcccaagccttccctgcaacaagaagacacttggccaggccaagaggtgaagttcttgtttattgttgcagcaactcttatacagacattagcgttcagttaaataaaggaagatagatagcacagtaaatacatcacaaccccaaactggatgactgtggccacgggacggaggagggagggagggagggaccagtgaccagactgtcaaggaagtacattcagtgggtgtgcggtgtccacattccaggctcacgtgtagatatattttatttatatatttatttatatttatatatagatcattgagttttgtgtatacaaagaacgatattgttacaaatacaatactatacttctcccgacactttacaataagctctatttcaccctctttacagaacaatagtacaagttcatactctaggtgctgtgctaagtatgtacaagaaatgtcattcccacacagtcctcacacactgccttgatggaggggaagaaagatcgagttgtgtgctcaagtcaacctaggccagggaaggagacacatgaaactcaaaccaacaggtggcctgtgaatgcgagtaaacacatctaaggaggggcggcccctggttgtaaacattggtaacggctacaccactgggtcgagggacccgggaagggctctgtagatggttttcatctgtgtgcgggaggtgttggtgcccacagggtgaggggggcagaggagcgatgggggaggtagtaggttactctgggactccctgaaggcggtgttgatgggcaatgttcagaaagcaaacccgtgcacagggacccggcacccctgccatgcactcctaggagcctgctctggcgagggaaggtgtcgctggagaagtgggctccaggcattggtctttgggggtttcttcctctcatgaacccaaggctgatggtggctccctgaaatgctcacactggagaaaaggcaggatgggttctggtgcctctgcctggaccaggagggggaggtgaacgtgggagtccaaccccaaagctgagccaccagcacaccctggtggagcagccacagcagctctgtgccctcacagcgtttgggaaggctgccctgtacatagccttcccattacatggggtatttagatatttacatgtataactatatatactgggatgacagaagggaagaccaccacttctcttgggactttcaaaaaatctagcgacttgcttttaagactgtggctgctgaggtgaccatacctaggctcactcccttgccccagtggtagtgggaaaaagaacccacttcagctgggtggacctgtaccgagctccagcaacttccactcactgggtgtgaagacacacctggattaacacaaaagaatgtggcagagaaatcttctcactctaatgttacaatgtcagtcctctaggagagcttgcagaattggctttttcagcacctctcaaagtttacaaggtttttgtgcaataggaatagaaagtatattctctcctttaggtgaacatacataaccgttatgtgcaggttgtacagggatgcactactggagttctgtcccctggccagtcgtgggcgggcctctgtggcactgcccaggtgcctagggacagacaggcatgggcccctacgatgattttccaaggctcctgatgcctgaaataccaccagtaacacttcattcctgttctatccactcttattggcagaggaaagatgaactggctgatgactctttagtgtctcactgtatcaccagatactctacagcaaatggagaaccctggccatggttccttcctggtcctcacgtttgtgatgggttgaccttgaggctggtctcccagaaacattctgtaaagcatccttcaaagaagtcctggggagctttacggaccatcccagagcccctggccccaccgggtgccactctctgcagcagcagaagtccctttccccccagggcacctgggcagccagcggcctcccttcctcagggctcctttgtaacacagtgaaactgagagtgccactgctcgttcctgtcaagcactgagcttccctgattctaagcagaaaactcagaagatgcagagatctcggggaattgatcacagaactctctggttgaagtctcttgtccctaatcttgttatagtcactttgctccctccttagaatccctccattctctctataaatacatgctacccaccatttgctcactgagttcctatttccatagacacaacataaatatctcggatgcagagaacagggactatattaattacaaaatataatagtttctcttcccctgtctctactgaggtcatgaatgaaacaaaacaaaagcaaagccaaatcacacctcacatgaacacaaaatgctctttggaccaagtgaaaactggctcagaattataatattactaaaacatctacactgaactgagacggaagcataaatatgaggcacctgatgaaaacacggaacaattccacaccagccaaaaatgctctcaggcccacaaggcagcaagagggtgtttatggaccacatctggggattctgaggcataacttgaggttgctattgtctccttaattttgtggtttatgtactattctggcctttccaatatcacatccgcctagtggccctgagcagagaagaaagttggtcttgccttgggccagaaaacaagacgcaattgcacctgcagcttgccttcttgggaacagtccctccttcccagactcctgggatgtgtgttcggcagggaggggagtccaggaggaggatgctttaagccaaagtggtgctggaggggctgggcctcagcgcagagagggcaggtctctcaggatgaggctgagcagcccccgcctgcctggccacctgccagggaaggggccttccagagaggtgggtttccaggggatctgtgtgcctaatcttcagcttgtctcactggtggtgggagcagggaagggtgatatgcaaatgggactgtgtgtgtgtgtgtgtgtgtgagagagagagaagcagacagtacctgcctgtgtttatctaatggttgataacttgaggacaacctggtaaagcttcagatgccccatgaattgccaagctctctgtgacactatggtgtccttgcccaaggcagttatttccccttttatcctggggtgagaaggctcgtattagaaaacacacatacgttgaaattagaactagcaatagaagaggtttaaggttggctcagagattctgggaagaaataatgtatggtgccccaactacatggcaggcagtgcataaccttaatgacgtgggctggccctgggtactaccacattcccacagataaactcagagagcagggatcagcaactgggttttaggcactgctgaatcagctgctttgctgccccgcgagctccttttaagaagtctgcacctcctgggaagggaggattctccctcaagcagtgacagcccaccccctggacacacccagaaagccctccaggatggtcctgggtcagtaccaggtgggtgctggctgctctccatcctcaagggagtgcatacgaaacttccctggtattgaaaaaaaaaaaaaaaaaaaagcaaatcggagagagtaaagaggtccttgtggattcttctcttcctgtgtaaaaccaaatgctgggcgcgagaggggaaagtctcagtggacacagggatgcagcacgagaaacacaaccacgaagaggagagtcctccatgcatgccaccgcgtgtggccgcggtcagatgtaaacaggctgctcctgggccgtcagcagcctgtacatcgcggctggcattgtcttcatatgaatctgagggtaaagaacacactttagtggggggctgaggctgggggctggctgcgtgggcactgcccagggctggccagagaggcagtgcctctcccacagagggctttgaagatactccctaccgcccagccaccaccagggacctgacccagggtggcctccaggaacagtggaatccactgactttctcaaaagcttaggggtgacagaaatgaacaacaaaaaccaagcaaggcttatttctcagtcaaatgctctcgctctcaccagaccctacccttttaaaagcaagaactctgaaaatggaggaagggctccaggcttctcagggtgcctgcctccctcatctctcttggcagatgaggcaaggatgacaaatcagccctagaacagcagtgatgattgatagcagtgatgaatgacagcagtgatgactgacagcaatgaatgacagcagtgttgactgacagcagtgataaatcaatgacagcagtgatgactgacagcagtggtaactgacagcagtgttgactgacagcagtgataaatgaatgacagcagtgttgactgacagcagtgataaatgaatgacagcagtgatgactgacagcagtgatgaatgacagcagtgatgactgacagtagtgatgactgataggagtgatgaatggcaacaatgatgactgactgacagctgtgatgactgacagtaatgacacgtcatgccacactgcactggggtcacacctctggaaggccactttgttgattcaacttgagtctaagacttaaatcttttaaaaacatttggggagattaactggggaaaatggaggcaacttaggcggccatacagaaaagcaacagaaagctgagtgttaaaaagagaaggtgagcacatcagatgaaagagaaggctgagggtgatctgattccatttcatggaggagctcccagataactgcttgctaatgggtttggcatttggtcagagacaggtctgcttgttggggagtgttcaggattggaaactcagggagctttcctggaaggtctgctcagggccacggtgagcatacgaggcaggggcaccagacgcggccctcagcaccaccctcagccccggacctctcctacctccccaacagcattggagagaatgtggacgatcttctcgtggggggtggccacgacgctctgtccattgatttcaatgatccggtgccccacacggacgcctcctctctcagctattccccctcgcatgaggctgcagatctgccagagtcaaaggcagagttaccctcattgcagacagtgcggtggggctggaaggccgtctttcctgaaagccccctgcccctacactctgctcttggagaaactgacatggttaggctttgggcatttaactctcttagtgtcttttcacaaaaaaataggtgccgtcggcccacatggccaccttgttcatgcggcttgcacagagactgtagcacatcactggtttttacggcacactgaattctacttctcatcccagctggggctgggtaaaaagggccatttgggtctgtcgcagagtcgccagtgtttccaaactgtcagcctgtgtgacacaggttagtgttagttcccgtagtcatgactgggactcaagcactgaagcgtttaatgccagcagactgtttttagggtcacgattgcctgagccaccatggggctggaactccactccgtgttccaaagtgtggctggctggaggggagagactccttcagagtttcccaattcagcggcccctgttcaaactcccttcccacagaaaagacagtgaggctggattttgtgatggcacagccaggtaccacagtgacccgaggttgcaggcggggctgatgcgccctccacccttacctcacacacactacaacataacttttcccaaaagagtaggtctgaatttactaagttggcttttcattccagaccatgcacctttatttaaaagtggatgcagacaagattgcaagtgacatcttgcagcaacatgctgtgtgattctgagtgtgtggcccagctgctctctcagctagtctggggtcaaaacattccttaggtgttttcccagtggacccacacatgttaacaactccttgttcgtatctgaacttttaatgcagtttaactatgaacaaagcaaacaagtacaagtacaaaccaatgaaaagatgatctcagagctaaactgtaaagagtcaccctagatcctctcctaataggcaaattaggctactcaggtacaaagaatgcaggaagtggggctggatatttcaactccaaatgggaagttcaagggtatttctaaaccttcaaatgtatttggaatgatattttaattacctaggactttttttttttttttttttttaagacagagtcttgctctgtcacctaggctggagtgcagtggcataatctctgctcactgcaacctttgcctcccgggttcaggtgatcctcctgcctcaccctcctgagtagctgggattacaggtgcccgccaccacacctggctactttttgtatttttagcagagactgggctttgccatgttggccaagctggtctcaaactcctggcctcaagtgatctgcctggcttcgccggaaggccaaggtttgaaggatcactcaaataccaaactgttcgagtcccaattgtgactgtgggaactgagccggcccctgcactgtacagccccaggcttgggagtcagctgctctgcgggactctgtgcagccagggtggacagtccagaggcaaggaggctcttggagggtgcatcccaaactctcaagctggcagccgggaaggcagtcctgcatgtcacagaaacactgggttctgggtgggaatctctgctgaagggactctgtccagagagggagctgagcctccttcatccactcatactctt

SEQ ID NO: 42 - DNA, 21146 bp, Homo sapiens
aatcacatttctaatagaaattgaatattggaggatttctagtgaacatgtgaggggaagaagatcaaaagatcactttgcactggaaacatttcactgtgtttgtgctgtggttggagatttcagtaagatgggagctgagcagaggcctactgtgtgtcctgtgaggccactgcactggaggcgacctcaggtgtcacttggaatgctgtctcttctcccttagccaaggcaggtcctggagaccttcagagcctgttttctaatgctgtggcaaacaactaaaatgtcgacatttgacctgtgtgctcccaaatggaccataaaaagatgattgcttattttatttagtaataaaagtaatatttttaggccacccctccacaagaaagcttagaaattgcttaagtagctgagaagctggccacagcaggtgtgctggtaagtgtttaacaaccagctctctgggggggaaactatgagtgtgcatctgtgcttatttacctgatataaagaatgtgtaacacacagtttacaaataataataatatattcactcattttttggggggggtgcaggtagaaactcactctgttgcccaggctggagtgcagtggtgcaatcatagctcactgcagccttaaactcctgggctcaagcaatcctcctgccccagcctcccaagtagctgggaccacaggcacgtgacaccatgtctggctaatgttttatgtttttgtagagaaggaggacttgcactgttgccctaactggtcttcaactcctaggctcaaatgatcctgttgcctcagcctcccaaagctctgagtttacaggtgtgagccaccatgccccgcctcactaatctttattgcaaatgccacccacctataacttcagtatgacttggtatttcctgcaaactcacaatcagtttttctaattctgttaccaagaatagtgtcaccaaaccagactacaaataaatgtttgactcctatgtgaatcgccaaagatgttactcataatactggtgaatgaatggagctctgacatgctacactgtgggaggctgtggctctgggtgtggtagagctggttgccatcataaagaaaagctcaagtgaatggggggagagcaggtagaactggaacccatgaggacagagttctgtcctacctgcctcccactgcagtgatgtggggacctgcaggaggagttagtcccactcacacctggcccaggtctcagagatactgagggagaatctggaggagctgccgaccggctgcttctctgagccgctggtgcaagccagcagaccatcgacaacgtgtatgagctgcgacagcccctggtgttgccgggacccacagtgcattttggctgacgcttcctatctgccctccaaatctcacctaaacctctcctgcagtcctcatttggaatcatacagggagggaagtctggaaaacaaagttctagcctagttaagttgacttgatggaacgccaccatgcttgcttgatgcttctgtgctaggtggggatctcctcaccctgttgttccaggtttctttgcctctgcatggaaagctgtttttcaaccatgggacctggaaaactcctgtagtatattcaaaccctgcaaagatctcactcgctctgagaaaagctcccggacccttcccctccaggactagttctgtaccttgtactcaatgactgtgtctactgcacatgctaaatgttcaaggacagagtcactaatggttagaacaactgagccaagctgtgcccatcgcataggtgaagaactggaggagcagagtggttgagtagcttgccaagatcacacagtgacaattggtaggaaagctgtaatttgaacccggtctgtgactcctcttttaattataacccacggtgactagaaagtcaagggagatttggctcctgcccataagaaactccaattagtggaggggaaagaggtggttaaggtagtaagtagctggtcagttgtgctatgtctgagactgacaataggagcagaatgtggagtagaccctggataagggggtccagggtaggaatgaggttgtttcccgccttccgccttccgccttccacttcccgcagcggtagcctcagccttctaggaatggcttctccccagctggaggaagggactagaaggcagcagttatctatgctgcttgccgcgccactgtcacaaagactctggagctagcctgagaactggggtcacagcagtgtgctcagcctacctccagggcctcctgggtctggccagtaggaagatgaggtccgcgttgttgtctgtcagcagctgggatcatacaaaggagcattagcctgggagctagggagtgaggttctagctgcctgctcgctgtgtagtctccagcaagtcctacccctcttggggtctttggtttccttatctggaaaacaaggggcctgggatgggtggccaaggctcctccttccctcaatcgcctgggaatcttggcagttatttggatttggcatttctcatgtaattccaccagagggcgccaaatactagctcttaccaacttggttcctgaagcgggtgtctgctggggagggcgcagaggaggtggagtgtgagttgagtgtgatagtgtggaagcaattagcaattaagtgtatgtgagtgagtgtgtgtgtgtgtgtgtgtgtgtgtgtagcaccaaagctcctgtaaccgcctatatctcccaccaccaccctctgcctgctggctgcatcttcagccacttgaattctcctttcttagcctccacgccctaccagagaggcctggcctcagggcctttgtccttgctgtccctttagcttggaacacgcatccctaaggcatccacagggccctccctcacttcttcttcatgaggcattcctaaccaacctacataaaatagccacccccaaactcattctaagctttagttaaaaacattaaagaaaactgtggtaaaatataccataacataaaaagtactattttaaccattaatttttaaaataagaatatagttaaatacatataacataaaatttcccatcttagctatttttaagtgcatagttcagtagtgtagcgtacattcacattgctgtgcaatcagtctgcagggctctctttttctggcaaaactggagctctgtacctacttaacaataactcttcatttcctccactcctctactttctgtctgtaagaatttgactacatcaggtatctcatgtaagtggaattatacagtatttatcttcttgtgactggcttatttcactcagcataatgtccttccagtagcgataaacccttatgctagcatgtgccagaatttccttcctttttaaggctgaataatatcccactgtgtgcctgtaccatgttgtgttgacccactcatcgatggacactttggttgcttctgtcttttggctgttgtgaataatgctaccataaatagggatgtacaaatacctgtttgaactcctgatttcaattattgttattattattttttgagacaaggtcttagtctgttgcccagcctggattgcagtggcacaatttcaactcactgaagccttgacctcccaagccctaagcaatcctcccaattcagcttcctgagtagctgggactccagacttgcaccaccacgtccagttaattttatttttttttgtggagacagggttttgctatgttgcccagactggtctggaactcctgagctcaaatgatccccctgtcttggcctcccaaagtgctgagatcacaggtgtgagctatcacacctggcccctgctttcaattcttgttccatgcttttatattttattttattttatttattttgagatagggtctcgctctgttgcccaggctggagggcagtgtccatgctttattttttctgcagagcactaattaccaaccaactgccctcctcctgcccacaactagagatgcaaatgatttctatttggtagaaagataaccctaaaggttataattgtattgccttaaggacattagccagttttgttttattttattttattgttgagacggagtctcgctctgtcacccaggctgtagtgcagtggtgcaatctcggctcactgcaacctccgcttcctgggttcaagcgattctcatgcctcagtctcccatgttgctgggattacagatgcccaccactatgcctaatttttgtgtttttggtagaggtggggtttcaccacgttggccaggctggtttcaatctcctgacctcagatgatccacccgcctcggcttcccaaagttctgggattacaggtgtgagccaccatgcccagtcgcaaccggttttacttcaaacctagtaattttattctaacattcttttaaaaatgtctataaatacttaggtcctccaaatactttttggaccagctttaccatcttacttgtttcatcattaatgattaataaatctctgatatgtgttcattccatctttgttatgggagttatgttttttaacttttaaaaaagtatgcattggcatctagaagtttttcccaggggctaaaatctgcttttggatgaaattcagtacatcagtagtttaggacttcgggtgtttgggggcgacctgcactaagccatgcaagtgcgtgcggagcctcttgagttgtggctcccgttggtgtacccagggggtctggaaattccaggaagcttatgaggacctggatctgctgggccccaggaacggccagtacttcctcagcaaccactatgcgccatgcacattctgaaagctttctatgtgttagcttatcctcacacggtctccctgagataaacactagtttgcagatgaggaaacaagctcagagggtttaaggaactctgaggatcacagtttaagcaaaaattatagaagaaagacctaaataaagtggttctatgtgcatcaaggtggttaaatggtttttttctctagttctgcaatttcatctaagatcaaagccaagagggggaagctaaggtatagtctatggtaggagcagccttgcctgtgggggcagaccacacccacacaggcagataccatccatcaggggactgtggtctcctgtgggacagacagacttccagggagcttgctgagaggtgccagttcaaagactagaccctcccaccagctgtcttcccaccgtcatcctggtgatgtgagaggggtgttgtcattggcgggggatgggtgcagaattcaggaaaggagctacttactcgccactccactctgggaggcaagggaatattgacctcgtcaagggaggcgaatcccaagagcatcactgtgaaggctgggggcctgtgccctccacttgcctccccacacactgaactgggtgctggtaacgtcttatctacatgtggccgagggaccggaccagcagaaggtgtggtgctgtgggtggtgagagagataataggaagcaatggctctgggatgggcaggggagagacagccaggggtgcccctcccttcctctgagggtgaggaggatggttgctggatgcttcaggagcttgctggctggggagatggtggctgcaggcggctggggacacaacctgtgtggaagaggtgtgcactttagaggtgtgcacagattggtaccagtctgtggcctgttaggaactgtgccacacagcaggaggcgagcaacaagtgaacaaagcttcatgtgtatttacagccgctcgccgtcgctggctcacattaccgcctgagctccgcctcctgtcagatctgcggcagcattagattctcataggagtgtgaaccctatcgtgaactgtgcatgcgagggatctaggttgcaggctccttatgagaatctaatgcctgatgatctgtcactgtctcccatcagccctagaagggaccattgagttgcaggaaaaccagttcagggctcccactgaattatacagttcaccatagaattgtgaactgtataattatacaattctatggtgaattgtataattatttcattatataacaatcagagaaataaagtgcacaataaatataatgtgcttgaatcatccccctccgtggcacccggtctctggaaagactgtcttccatgaaactggtccctggtgccaaaaaaggtggagactgctgctttagaggactgtggctaaggggtcagctggaagatggggcccagggctcagggaccctgaatgcccggttgctgccaattgtttgtcttcattgatctcctggtcagtggaccagatcagcagaatgaaccagcaaggcgaggactgtgaccttcccaagggcaactcttaatgtaggggaacctctgtgcacctcctacccatgccccttcccataaagggactcaaagaaggagacagggagggagggagggagctgagagcaagtcccgctctcctaggccagtgctcaattccagtctggggatggggaagtagggcagactgatttgaataagagatgtggtttgcaaatcaatggaagaaaaccaggaaggaaaacattataagaaccaaaagagacccaaaagtctaacgctgagttcatccgtgtgcgatgacaagcctgtcccaggtgggtgcaggtgggagttgttggaaagctgagcataagtgcttgaaccctctgtgcccgtttcctcctgtataaaatggagacaatgataatacaggaaaagcttctacctcttagaggtgttgtggggagttaccaagttcatctctgtaggatgcttggcacatggaagttactataaagactagctgccattcttcaaattgtgacttccccagacaccagttcaatgtgctttcttcccacttgattcaatggcagccgtctcggtggtgggacactctgcttgctgtgaggaggatggaggagaaggggctcctcggggccaggccacaggaccctcaggataaggccctgcctccatgttcagggctttcagcagctacagacctgacggggctgcaaaaagctttgcagggaagatgggggaggggtgtatgcaaagaaaaagctgacaagcagtctgctttggaacagggctggacactctgtgttggggagtccagggcccccagcatgcccccggcagcagggagggcatgcctggcaaccttcaaaaagtgaatttccaaagagcaccaggaggaaaccttccagaaccttctcacagaacctttggatgggcctctcagggcgctgttttccaccgtccacttagatcttagtcccttacaaaaaggtacctcccttacgggagatgactgaggtgggggagaattaattcctgttttcctgccctcatggaggatgtcaagtaagaaatccggagaatttctctttctccagttcagtgtgctcaaaggagacccacaggactggaggatcaactgggacaggagaacagagcctttcttgtctaaaaccaagtcagttccacagaataaaagctcatttagagaactcctgggctctgggcgcctatagggtgggtaggagctagtcagtcagtctgttagggaaaagacaaactcatcacatgatcccaagccttccctgcaacaagaagacacttggccaggccaagaggtgaagttcttgtttattgttgcagcaactcttatacagacattagcgttcagttaaataaaggaagatagatagcacagtaaatacatcacaaccccaaactggatgactgtggccacgggacggaggagggagggagggagggaccagtgaccagactgtcaaggaagtacattcagtgggtgtgcggtgtccacattccaggctcacgtgtagatatattttatttatatatttatttatatttatatatagatcattgagttttgtgtatacaaagaacgatattgttacaaatacaatactatacttctcccgacactttacaataagctctatttcaccctctttacagaacaatagtacaagttcatactctaggtgctgtgctaagtatgtacaagaaatgtcattcccacacagtcctcacacactgccttgatggaggggaagaaagatcgagttgtgtgctcaagtcaacctaggccagggaaggagacacatgaaactcaaaccaacaggtggcctgtgaatgcgagtaaacacatctaaggaggggcggcccctggttgtaaacattggtaacggctacaccactgggtcgagggacccgggaagggctctgtagatggttttcatctgtgtgcgggaggtgttggtgcccacagggtgaggggggcagaggagcgatgggggaggtagtaggttactctgggactccctgaaggcggtgttgatgggcaatgttcagaaagcaaacccgtgcacagggacccggcacccctgccatgcactcctaggagcctgctctggcgagggaaggtgtcgctggagaagtgggctccaggcattggtctttgggggtttcttcctctcatgaacccaaggctgatggtggctccctgaaatgctcacactggagaaaaggcaggatgggttctggtgcctctgcctggaccaggagggggaggtgaacgtgggagtccaaccccaaagctgagccaccagcacaccctggtggagcagccacagcagctctgtgccctcacagcgtttgggaaggctgccctgtacatagccttcccattacatggggtatttagatatttacatgtataactatatatactgggatgacagaagggaagaccaccacttctcttgggactttcaaaaaatctagcgacttgcttttaagactgtggctgctgaggtgaccatacctaggctcactcccttgccccagtggtagtgggaaaaagaacccacttcagctgggtggacctgtaccgagctccagcaacttccactcactgggtgtgaagacacacctggattaacacaaaagaatgtggcagagaaatcttctcactctaatgttacaatgtcagtcctctaggagagcttgcagaattggctttttcagcacctctcaaagtttacaaggtttttgtgcaataggaatagaaagtatattctctcctttaggtgaacatacataaccgttatgtgcaggttgtacagggatgcactactggagttctgtcccctggccagtcgtgggcgggcctctgtggcactgcccaggtgcctagggacagacaggcatgggcccctacgatgattttccaaggctcctgatgcctgaaataccaccagtaacacttcattcctgttctatccactcttattggcagaggaaagatgaactggctgatgactctttagtgtctcactgtatcaccagatactctacagcaaatggagaaccctggccatggttccttcctggtcctcacgtttgtgatgggttgaccttgaggctggtctcccagaaacattctgtaaagcatccttcaaagaagtcctggggagctttacggaccatcccagagcccctggccccaccgggtgccactctctgcagcagcagaagtccctttccccccagggcacctgggcagccagcggcctcccttcctcagggctcctttgtaacacagtgaaactgagagtgccactgctcgttcctgtcaagcactgagcttccctgattctaagcagaaaactcagaagatgcagagatctcggggaattgatcacagaactctctggttgaagtctcttgtccctaatcttgttatagtcactttgctccctccttagaatccctccattctctctataaatacatgctacccaccatttgctcactgagttcctatttccatagacacaacataaatatctcggatgcagagaacagggactatattaattacaaaatataatagtttctcttcccctgtctctactgaggtcatgaatgaaacaaaacaaaagcaaagccaaatcacacctcacatgaacacaaaatgctctttggaccaagtgaaaactggctcagaattataatattactaaaacatctacactgaactgagacggaagcataaatatgaggcacctgatgaaaacacggaacaattccacaccagccaaaaatgctctcaggcccacaaggcagcaagagggtgtttatggaccacatctggggattctgaggcataacttgaggttgctattgtctccttaattttgtggtttatgtactattctggcctttccaatatcacatccgcctagtggccctgagcagagaagaaagttggtcttgccttgggccagaaaacaagacgcaattgcacctgcagcttgccttcttgggaacagtccctccttcccagactcctgggatgtgtgttcggcagggaggggagtccaggaggaggatgctttaagccaaagtggtgctggaggggctgggcctcagcgcagagagggcaggtctctcaggatgaggctgagcagcccccgcctgcctggccacctgccagggaaggggccttccagagaggtgggtttccaggggatctgtgtgcctaatcttcagcttgtctcactggtggtgggagcagggaagggtgatatgcaaatgggactgtgtgtgtgtgtgtgtgtgtgagagagagagaagcagacagtacctgcctgtgtttatctaatggttgataacttgaggacaacctggtaaagcttcagatgccccatgaattgccaagctctctgtgacactatggtgtccttgcccaaggcagttatttccccttttatcctggggtgagaaggctcgtattagaaaacacacatacgttgaaattagaactagcaatagaagaggtttaaggttggctcagagattctgggaagaaataatgtatggtgccccaactacatggcaggcagtgcataaccttaatgacgtgggctggccctgggtactaccacattcccacagataaactcagagagcagggatcagcaactgggttttaggcactgctgaatcagctgctttgctgccccgcgagctccttttaagaagtctgcacctcctgggaagggaggattctccctcaagcagtgacagcccaccccctggacacacccagaaagccctccaggatggtcctgggtcagtaccaggtgggtgctggctgctctccatcctcaagggagtgcatacgaaacttccctggtattgaaaaaaaaaaaaaaaaaaaagcaaatcggagagagtaaagaggtccttgtggattcttctcttcctgtgtaaaaccaaatgctgggcgcgagaggggaaagtctcagtggacacagggatgcagcacgagaaacacaaccacgaagaggagagtcctccatgcatgccaccgcgtgtggccgcggtcagatgtaaacaggctgctcctgggccgtcagcagcctgtacatcgcggctggcattgtcttcatatgaatctgagggtaaagaacacactttagtggggggctgaggctgggggctggctgcgtgggcactgcccagggctggccagagaggcagtgcctctcccacagagggctttgaagatactccctaccgcccagccaccaccagggacctgacccagggtggcctccaggaacagtggaatccactgactttctcaaaagcttaggggtgacagaaatgaacaacaaaaaccaagcaaggcttatttctcagtcaaatgctctcgctctcaccagaccctacccttttaaaagcaagaactctgaaaatggaggaagggctccaggcttctcagggtgcctgcctccctcatctctcttggcagatgaggcaaggatgacaaatcagccctagaacagcagtgatgattgatagcagtgatgaatgacagcagtgatgactgacagcaatgaatgacagcagtgttgactgacagcagtgataaatcaatgacagcagtgatgactgacagcagtggtaactgacagcagtgttgactgacagcagtgataaatgaatgacagcagtgttgactgacagcagtgataaatgaatgacagcagtgatgactgacagcagtgatgaatgacagcagtgatgactgacagtagtgatgactgataggagtgatgaatggcaacaatgatgactgactgacagctgtgatgactgacagtaatgacacgtcatgccacactgcactggggtcacacctctggaaggccactttgttgattcaacttgagtctaagacttaaatcttttaaaaacatttggggagattaactggggaaaatggaggcaacttaggcggccatacagaaaagcaacagaaagctgagtgttaaaaagagaaggtgagcacatcagatgaaagagaaggctgagggtgatctgattccatttcatggaggagctcccagataactgcttgctaatgggtttggcatttggtcagagacaggtctgcttgttggggagtgttcaggattggaaactcagggagctttcctggaaggtctgctcagggccacggtgagcatacgaggcaggggcaccagacgcggccctcagcaccaccctcagccccggacctctcctacctccccaacagcattggagagaatgtggacgatcttctcgtggggggtggccacgacgctctgtccattgatttcaatgatccggtgccccacacggacgcctcctctctcagctattccccctcgcatgaggctgcagatctgccagagtcaaaggcagagttaccctcattgcagacagtgcggtggggctggaaggccgtctttcctgaaagccccctgcccctacactctgctcttggagaaactgacatggttaggctttgggcatttaactctcttagtgtcttttcacaaaaaaataggtgccgtcggcccacatggccaccttgttcatgcggcttgcacagagactgtagcacatcactggtttttacggcacactgaattctacttctcatcccagctggggctgggtaaaaagggccatttgggtctgtcgcagagtcgccagtgtttccaaactgtcagcctgtgtgacacaggttagtgttagttcccgtagtcatgactgggactcaagcactgaagcgtttaatgccagcagactgtttttagggtcacgattgcctgagccaccatggggctggaactccactccgtgttccaaagtgtggctggctggaggggagagactccttcagagtttcccaattcagcggcccctgttcaaactcccttcccacagaaaagacagtgaggctggattttgtgatggcacagccaggtaccacagtgacccgaggttgcaggcggggctgatgcgccctccacccttacctcacacacactacaacataacttttcccaaaagagtaggtctgaatttactaagttggcttttcattccagaccatgcacctttatttaaaagtggatgcagacaagattgcaagtgacatcttgcagcaacatgctgtgtgattctgagtgtgtggcccagctgctctctcagctagtctggggtcaaaacattccttaggtgttttcccagtggacccacacatgttaacaactccttgttcgtatctgaacttttaatgcagtttaactatgaacaaagcaaacaagtacaagtacaaaccaatgaaaagatgatctcagagctaaactgtaaagagtcaccctagatcctctcctaataggcaaattaggctactcaggtacaaagaatgcaggaagtggggctggatatttcaactccaaatgggaagttcaagggtatttctaaaccttcaaatgtatttggaatgatattttaattacctaggactttttttttttttttttttttaagacagagtcttgctctgtcacctaggctggagtgcagtggcataatctctgctcactgcaacctttgcctcccgggttcaggtgatcctcctgcctcaccctcctgagtagctgggattacaggtgcccgccaccacacctggctactttttgtatttttagcagagactgggctttgccatgttggccaagctggtctcaaactcctggcctcaagtgatctgcctggcttcgccggaaggccaaggtttgaaggatcactcaaataccaaactgttcgagtcccaattgtgactgtgggaactgagccggcccctgcactgtacagccccaggcttgggagtcagctgctctgcgggactctgtgcagccagggtggacagtccagaggcaaggaggctcttggagggtgcatcccaaactctcaagctggcagccgggaaggcagtcctgcatgtcacagaaacactgggttctgggtgggaatctctgctgaagggactctgtccagagagggagctgagcctccttcatccactcatactctttcttgatggattccttcagggaacaaactggcttaaaacaaaaaaaaaaaagtcaaaggccctgggagcctgggataccagcactttgggaggcagaggcaggtggatcacaaggtcaggagttcaagaccggcctggccagtatggtgaaaccatgcctctactaaaaatacaaaaattagccgggcgtggtggcacgtgcctgtagtcccagctactcaggaggctgaggcaggagaatcccttgaacccaggaggtggaggttgcagtgagccgagatcgtgccactgtactccatcttggatgacagagcgagactccatctcaatttaaaaaaaaaaaaaaaggccatgctacatttttttaaagcattccaacagatgtttattattactaaaatgtccactttaacgtttttattattattagtatactttaagttttagggtacatgggcacaacgtgcaggtttgttacatatgtatacatgtgccatgttggtgtgctacacccattaactcgtcatttagcattaggtatatctcctaatgctatccctcccccctccccccaccccacaacagtccccagtgtgtgatgttccccttcctgtgtccatgtgttctcattgttcaattcccacctatgagtgagaacatgcagtgttggttttttgtccttgccatagttttctgagaatgatggtttctagcttcatccatgtccctacaaaggacatgaactcatccttttttatggctgcatagtattccatggtgtatatgtgccacattttcttaatctagtctatcattgttggacatttgggttggttccaagtctttgctattgtgaatagtgccacaataaacatacgtgtgcatgtgtctttgcagcagcatgatttatagtcctttgggtgtatacccagtaatgggatggctgggtcaaatggtatttctagttctagatccctgaggaatcgccacactgacttccacaatggttgaactagtttacagtcccaccaacagtgtaaaagtgttcgtatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcatcttttgagaagtgtttgttcatatccttcacccactttttgatggggttgtttttttcttgtaaatttgtttgagttcattgtagattctggatattagccctttgtcagatgagcaggttgtaaaaattttctccctttctgtaggttgcctgttcactccgatggtagtttcttttgctgtgcagaagctcttgagtttaattagatcccatttgtcaattatggcttttgttgccattgcttttggtgttttagacatgaagtacttgcccatgcctatgtcctgaatggtattgcctagggtttttatggttttaggtctaacatgtaggtctttaatccatcttgaattaattttttataaggtgtaaggaagggacccaatttcagctttctacatatggctagccagttttcccagcaccatttattaaatagggaatcctttcccccattgcttgtttttctcaggtttgtcaaagatcagacagttgtagatatgtggcattatttctgagggctctgttctgttccattggtctatatctctgtttggtaccagtaccatgctgttttggttactatagccttgtagtatagtttgaagtcaggtagcgtgatgcctccagctttgttcttttagcttaggattgacttggcaatgtgggctcttttttggttccatatgaattttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcctttatttccttgagcagtggtttgtagttctccttgaagaggtccttcacatcccttgtaagttggattcctaggtattgtattctctttgaagcaattgtgaatgggagttcactcatgatttggctctctgtttgttgttggtgtataagaatgcttgtgatttttgcacattgattttgtatcctgagactttgctgaagttgcttatcagcttaaggagattttgggctgagacagtggggttttctagatatacaatcatgtcatctgcaaacagggataatttgacttcctcttttcctaattgaatgccctttatttccttctcctgcctaattgccctggccagaacttccaaaactatgttgaataggagtggtgagagagggcatccctgtcttgtgccagttttcaaagggaatgcttccagtttttgtccattcggtatgatattggctgtgggtttgtcatagatagctcttattattttgagatacatcccatcaatacctaatttattgagagttttttagcatgaagcgttgttgaattttgtcaaaggccttttctgcatctattgagataatcatatggtttttgtctttggttctgtttatatgatggattatgttaattgatttttgtatgttgaaccagccttgcatcccagggatgaagcccacttgatcatggtggataagctttttgatgtgttgctggattcagtttgccagtattttattgaggatttttgcatcaatgttcatcaacgatattggtctaaaattatcttttttggttgtgtctctgcccggctttggtatcagaatgatgctggcctcataaaatgagttagggaggattccctctttttctattgattggaatagtttcagaaggaatgctaccagctcctccttgtacctctggtagaattcggctgtgaatccatctggtcctggactctttttggttggtaagctattaattattggctcaatttcagagcctgttattggtctattcagagattcaacttcttcctggtttagtcttgggagggtgtatgtgttgaggaatttatccatttcttctagattttctagtttatttgagtagaggtgtttatagtattctctgatggtagtttgtatttctgtgggatcattggtgatatcccctttgtcattttttattgcgtctatttgattcttctctcttttcttctttattagtcttgctagcggtctatcaattttgttgatcttttcaaaaaaccagctcctggattcattgattttttgaagggttttttgtgtctctatttccttcagttctgctctgatctgagttatttcttgccttctgctagcttttgaatgtgtttgctcttgcttctctagttctttcaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggggtggtgctgaaaagaatgtatattctgttgatttggggtggagagttctgtagatgtctgttaggtccgctttgtgcagagctgagttcaattcctggatatccttgttaactttctgtctcattgatctgtgtaatgttgacaatggggtgttaaaatctcccattattattgtgtgtgagtctaagtctctttgtaggtcactaaggacttgctttatgaatctgggtgctcctgtattgggtgcatgtatatttaggagtgttagttcttcttgttgaattgatccctttaccattatgtaatggccttctttgtctcttttgatctttgttggtttaaagtctgttttatccgatactaggattgaaacccctgcctttttttgttttccgtttgcttggtagatcttcctccatccctttattttgagcctatgtgtgtctctgcacatgagattggtttcctgaatacagcacatggatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagttttttcctagcctcgatggtctttacaatttggcatgtttttgcagtggctgttactggttattcctttccatgtttagtgcttccttcaggagctgttttacagcaggtctggtggtgacaaaaatctctcagcatttgcttgtctgtaatgtactttatttctccttcacttatgaagtttagtttggctggatatgaaattctggcttgaaaattcttttctttaagaatgttgaatattggccccactctcttctggcttgtagagtttctgccaagagatccgctgttagtctgatgggcttccctttgtgggtaacctgacctttctctctggctgcccttaacgttttttccttcatttcaactttggtgaatctgacaattatgtgtcttggagttctcttctcgaggagtatctttgtggcgttctctgtatttcctgaatttgaatgttggtctgccttgctagattggggaaattctcctggataatatcctgcagagtgttttccaacttggttccattctccccgtcactttcaggtacaccaatcagacgtagatttggtcttttcacatagtcccatatttcttggaggctttgttcctatctatctatctttttattcttttttctctaaaatcctctttatgcttcatttcattcatttcatcttccattgctgataccctttcttccagttgatcacatcggttactgaggcttgtgcatttgtcacattcttgtagtgtggttttcagctccatcaggtcctttaaggacttctctgcattggttattctagttatccattcgtctaattttttttcaaagtttttcacttctttgccattggtttgaacttcctcctttagctcagagtagtttgatcttctgaagccttcttctctcaactcgtcaaagtcattctccatccagctttgttccgttgctggtaaggagctgtgttcctttgcaggaggagaggtgctctggtttgtagagtttctggtttttctgctctgttttttccccatctttgtggttttatctacctttggtctttgatgatgctgacgtacagatgggtttttggtttggatgtcctttctgtttgttagttttccttctaacagtcaggaccctcagctgcaggtctgttggagtttactggaggtccactccagaccctgtttgcctgggtatcagcagcagtggctgcagaacagcggatattggtgaaccgcaaatgctgctgcctgatcgttcctctggaagttttgtctcagaggagtacccggctgtgtgaggtgtcagtctgctcctactggggggtgcctcccagttaggctactcaggggtcagggacacacttcaggaggcagtctgcccattctcagatctcaagctgtgtgctgggagaaccactactctcttcaaagctgtcagacagggacatttaagtctgtagaggttactgctgccttttgtttgtctgtgccctgcccccagaggtggagcctacagaggcaggcaggcctccttgagctgtagtgggctccaccccgttcgagcttccccgctgctttgtttacctactcaagcctgggcaatggtgggtgcccctcccccagcctcgctgccaccttgcagtttgatctcagactgctgtgctagcaatgagtgaggctccatgggcgtaggaccctccgagccaggtgtggggtataatctcctggtgtgccgtttgttatgcccattggaaaagtgcagtattagggtgggagtgacccgattttccaggtgctgtctgtcacccctttctttgactaggaaagggaattccctgaccccttgcgcttcccgggtgaggcgatgccttgtcctgcttcagctcttgcacagtgcgctgcacccactgtcctgcacccactgaccggcactccccagtgagatgaacctggtacctcagttggaaatgcagaaattacccgtcttctgcatcactcacgctgggagttgtagactggagctgttcctatttagccatcttggctccacccccccagc

SEQ ID NO: 43 - DNA, 21170 bp, Homo sapiens
catgtctaactctagcctacctttcctgtcaaactgggttggctgtgctccccacggccaaatcatccctctccctggcccctgctccccggaggctgcccacctggctcccgcagctccatccaccttccccaagctccctgcaggttctgttcatcttctccctgagatgtcatttgtgctgagcagtctgcctgatatttcagctacctgggtacctgtgggtctcacccctgatcacaggctcctcagggaagaggggatgggaaagtacaagacagaatgaagtttgtgtcatcactctgggattttgggcaaattacctagcacatgtgaggtcagtttcttcatcagtaaaatggggataatacctgctctgtgatattgctgtgcagttaagtgctagagcctatgcagctcatttgcctggcatcttataggtgctcaaagaatgttagttcttatcataactgttagtgagcttggttggaatggtgagtggtttttttttaatcacttttttttttaaaattttattatttctatactttaagtgttagggtacatgtatacaacgtgcaggtttgttacatatgtatacatgtgccatcttggtgtgctgcacccattaactcgtcatttacattaggtatatctcctaatgctatccctcccccatccccccaccccacaacagtccccagtgtgtgatgttccccttcctgtgtccatgtgttctcattgttcaattcccacctatgagtgagaacatgcggtgtttagtttttttgtccttgccatagtttgctgagaatgatggtttccagcttcatccatgtctctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtgtatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttagtgatcgccattctaactggtgtgagatggtatctcattgtggttttgatttgcatttctctgatggccagtgatgatgagcattttttcatgtgtttttttggctgcataaatgtcttcttttgagaagtgtctgttcatatcctttgtccactttctgatggggttgtttgtttttttcttgtaaatttgtttgagttcactgtagattctggatattagccctttgtcagatgagtaggttgcaaaaattttctccctttctgtaggttgccaaaattttctccctttctgtaggttgccttttcactctgatggtagtttcttttgctgtgcagaagctctttagtttaattagatcccatttatcaattttggcttttgttgccattgcttttggtgttttagacatgaagtcctggcccatgcctatgtcctgaatggtattgcctaggttttcttctagggtttttatggttttaggtctaacatgtaagtctttaatccatcttgaattaatttttgtataaggtgtaaggaagggatccagtttcagctttctacatgtggctagccagttttcccagcaccatttattaaatagggaatcctttccccattgcttgtttttctcaggtttgtcaaagatcagacagttgtagatatgtggcattatttctgagggctctgttctgttccattggtctatatctctgttttggtaccagtaccatgctgttttggttactgtagccttgtagtatagtttgaagtcaggtagcgtgatgactccagctttgttcttttggcttaggattgacttggcaatgcaggctcttttttggttccatatgaactttaaagtagttttttccaattctgtgaagaaagtcattggtagcttgatgggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattgtattctctttgaagcaattgtgaatgggagttcgctcatgatttggctctctatctgttattggtatataagaatgcttgtgatttttgcacattgattttgtatcctgagactttgctgaagttgcttatcagcttaaggagattttgggctgagacagtggggttttctagatatacaatcatgtcatctgcaaacagggataatttgacttcctcttttcctaatcgaatgccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttattgagagatttttagcatgaagcgttgttgaattttgtcaaaggccttttctgcatctattgagataatcatgtggtttttgtctttggttctgtttatatgcttgattacatttattgattttcatatgttgaaccagccttgcatcccagggataaagcccacttgatcatggtgaataagctttttgatgtgttgctggattcggtttgccagtattttattgaggatttttgcatcaatgttcatcaaggatattggtctaaaattctctttttttgttgtgtctcagccaggctttggtatcaggatgatgctggcctcataaaatgagttagggaggattccctctttttctattgattggaatagtttcagaaggaatgctaccagctcctccttgtacctctggtagaattcggctgtgaatccatctggtcctggactctttttggttggtaagctattaattattggctcaatttcagagcctgttattggtctattcagagattcaacttcttcctggtttagtcttgggagggtgtatgtgttgaggaatttatccatttcttctagattttctagtttatttgagtagaggtgtttatagtattctctgatggtagtttgtatttctgtgggatcattggtgatatcccctttgtcattttttattgcgtctatttgattcttctctcttttcttctttattagtcttgctagcggtctatcaattttgttgatcttttcaaaaaaccagctcctggattcattgattttttgaagggttttttgtgtctctatttccttcagttctgctctgatctgagttatttcttgccttctgctagcttttgaatgtgtttgctcttgcttctctagttctttcaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggggtggtgctgaaaagaatgtatattctgttgatttggggtggagagttctgtagatgtctgttaggtccgctttgtgcagagctgagttcaattcctggatatccttgttaactttctgtctcattgatctgtgtaatgttgacaatggggtgttaaaatctcccattattattgtgtgtgagtctaagtctctttgtaggtcactaaggacttgctttatgaatctgggtgctcctgtattgggtgcatgtatatttaggagtgttagttcttcttgttgaattgatccctttaccattatgtaatggccttctttgtctcttttgatctttgttggtttaaagtctgttttatccgatactaggattgaaacccctgcctttttttgttttccgtttgcttggtagatcttcctccatccctttattttgagcctatgtgtgtctctgcacatgagattggtttcctgaatacagcacatggatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagttttttcctagcctcgatggtctttacaatttggcatgtttttgcagtggctgttactggttattcctttccatgtttagtgcttccttcaggagctgttttacagcaggtctggtggtgacaaaaatctctcagcatttgcttgtctgtaatgtactttatttctccttcacttatgaagtttagtttggctggatatgaaattctggcttgaaaattcttttctttaagaatgttgaatattggccccactctcttctggcttgtagagtttctgccaagagatccgctgttagtctgatgggcttccctttgtgggtaacctgacctttctctctggctgcccttaacgttttttccttcatttcaactttggtgaatctgacaattatgtgtcttggagttctcttctcgaggagtatctttgtggcgttctctgtatttcctgaatttgaatgttggtctgccttgctagattggggaaattctcctggataatatcctgcagagtgttttccaacttggttccattctccaggtcactttcaggtacaccaatcagatgtagatttggtcttttcacatagtcccatatttcttggaggctttgttcctatctttttattcttttttctctaaacttctctttatgcttcatttcattcattttgtcttccatcactgataccctttcttccagttgatcacatcggctactgaggcttgtgcattcatcacgtagttctcttgccatggttttcagctccaaaggtcctttaaggacttctctgcattggttattctagttatccattcatctaattttttttcaaggtttttaacttctttgccattcgttcgaacttcctcctttagcttggagtagtttgattgtctgaagccttcttctctcagctcgtcaaagtcattctccatccagctttgttccgttgctggtgaggagctgcgttcctttggaggaggagaggtgctctgatttttagagttattccagtttttctgctctggtttttccccatctttgtgattttatctacctttgcctttgatgatggtgatgtacagatggggttttggtgtggatgtcctttctgtttgtttagttttccttctgacagttaggaccctcagctgcaggtctgttggagtttgctggaggtccactccagaccttgtttgcctgagtatcagcagcagtggctgcagaacagcgggtattggtgaaccgcaaatgctgctgcctgatcgttcctctggaagttttgtctcagaggagtacccggctgtgtgaggtgtcagtctgcccctactagggggtgcctcccggttaggctacttgggggtcagggacccactttaggaggcagtctgcccattctcagatctcaagctgtgtgctgggagaaccactactctcttcaaagctgtcagacagggacatttaagtctgcagaggttactgctgccttgtgtttgtctatgccctgccccaagaggtggagcctacagaggcaggcaggcctccttgagctgtggtgggctccacccagttcgagcttgttggcagctttgtttacctactcaagcctcggcaatggcgggcacccctcccccagccttgctgccaccttgcagtttgatctcagactgctgtgctagcaatgagcgaggctccatgggcgtaggaccctctgagccatgtgtgggatataatctcctggtgtgccatttgttaagcccaatgcctcgccctgcttcggctcacacaaggtgtgctgcacccactgtcctgcacccactgtccggcactccccagtgagatgaacctggtacctcagttggaaatgcagaaatcacccatcttctgcattgctcatgctgggagctgtagactggagctgttcctattcggccattttaatcacatttctaatagaaattgaatattggaggatttctagtgaacatgtgaggggaagaagatcaaaagatcactttgcactggaaacatttcactgtgtttgtgctgtggttggagatttcagtaagatgggagctgagcagaggcctactgtgtgtcctgtgaggccactgcactggaggcgacctcaggtgtcacttggaatgctgtctcttctcccttagccaaggcaggtcctggagaccttcagagcctgttttctaatgctgtggcaaacaactaaaatgtcgacatttgacctgtgtgctcccaaatggaccataaaaagatgattgcttattttatttagtaataaaagtaatatttttaggccacccctccacaagaaagcttagaaattgcttaagtagctgagaagctggccacagcaggtgtgctggtaagtgtttaacaaccagctctctgggggggaaactatgagtgtgcatctgtgcttatttacctgatataaagaatgtgtaacacacagtttacaaataataataatatattcactcattttttggggggggtgcaggtagaaactcactctgttgcccaggctggagtgcagtggtgcaatcatagctcactgcagccttaaactcctgggctcaagcaatcctcctgccccagcctcccaagtagctgggaccacaggcacgtgacaccatgtctggctaatgttttatgtttttgtagagaaggaggacttgcactgttgccctaactggtcttcaactcctaggctcaaatgatcctgttgcctcagcctcccaaagctctgagtttacaggtgtgagccaccatgccccgcctcactaatctttattgcaaatgccacccacctataacttcagtatgacttggtatttcctgcaaactcacaatcagtttttctaattctgttaccaagaatagtgtcaccaaaccagactacaaataaatgtttgactcctatgtgaatcgccaaagatgttactcataatactggtgaatgaatggagctctgacatgctacactgtgggaggctgtggctctgggtgtggtagagctggttgccatcataaagaaaagctcaagtgaatggggggagagcaggtagaactggaacccatgaggacagagttctgtcctacctgcctcccactgcagtgatgtggggacctgcaggaggagttagtcccactcacacctggcccaggtctcagagatactgagggagaatctggaggagctgccgaccggctgcttctctgagccgctggtgcaagccagcagaccatcgacaacgtgtatgagctgcgacagcccctggtgttgccgggacccacagtgcattttggctgacgcttcctatctgccctccaaatctcacctaaacctctcctgcagtcctcatttggaatcatacagggagggaagtctggaaaacaaagttctagcctagttaagttgacttgatggaacgccaccatgcttgcttgatgcttctgtgctaggtggggatctcctcaccctgttgttccaggtttctttgcctctgcatggaaagctgtttttcaaccatgggacctggaaaactcctgtagtatattcaaaccctgcaaagatctcactcgctctgagaaaagctcccggacccttcccctccaggactagttctgtaccttgtactcaatgactgtgtctactgcacatgctaaatgttcaaggacagagtcactaatggttagaacaactgagccaagctgtgcccatcgcataggtgaagaactggaggagcagagtggttgagtagcttgccaagatcacacagtgacaattggtaggaaagctgtaatttgaacccggtctgtgactcctcttttaattataacccacggtgactagaaagtcaagggagatttggctcctgcccataagaaactccaattagtggaggggaaagaggtggttaaggtagtaagtagctggtcagttgtgctatgtctgagactgacaataggagcagaatgtggagtagaccctggataagggggtccagggtaggaatgaggttgtttcccgccttccgccttccgccttccacttcccgcagcggtagcctcagccttctaggaatggcttctccccagctggaggaagggactagaaggcagcagttatctatgctgcttgccgcgccactgtcacaaagactctggagctagcctgagaactggggtcacagcagtgtgctcagcctacctccagggcctcctgggtctggccagtaggaagatgaggtccgcgttgttgtctgtcagcagctgggatcatacaaaggagcattagcctgggagctagggagtgaggttctagctgcctgctcgctgtgtagtctccagcaagtcctacccctcttggggtctttggtttccttatctggaaaacaaggggcctgggatgggtggccaaggctcctccttccctcaatcgcctgggaatcttggcagttatttggatttggcatttctcatgtaattccaccagagggcgccaaatactagctcttaccaacttggttcctgaagcgggtgtctgctggggagggcgcagaggaggtggagtgtgagttgagtgtgatagtgtggaagcaattagcaattaagtgtatgtgagtgagtgtgtgtgtgtgtgtgtgtgtgtgtgtagcaccaaagctcctgtaaccgcctatatctcccaccaccaccctctgcctgctggctgcatcttcagccacttgaattctcctttcttagcctccacgccctaccagagaggcctggcctcagggcctttgtccttgctgtccctttagcttggaacacgcatccctaaggcatccacagggccctccctcacttcttcttcatgaggcattcctaaccaacctacataaaatagccacccccaaactcattctaagctttagttaaaaacattaaagaaaactgtggtaaaatataccataacataaaaagtactattttaaccattaatttttaaaataagaatatagttaaatacatataacataaaatttcccatcttagctatttttaagtgcatagttcagtagtgtagcgtacattcacattgctgtgcaatcagtctgcagggctctctttttctggcaaaactggagctctgtacctacttaacaataactcttcatttcctccactcctctactttctgtctgtaagaatttgactacatcaggtatctcatgtaagtggaattatacagtatttatcttcttgtgactggcttatttcactcagcataatgtccttccagtagcgataaacccttatgctagcatgtgccagaatttccttcctttttaaggctgaataatatcccactgtgtgcctgtaccatgttgtgttgacccactcatcgatggacactttggttgcttctgtcttttggctgttgtgaataatgctaccataaatagggatgtacaaatacctgtttgaactcctgatttcaattattgttattattattttttgagacaaggtcttagtctgttgcccagcctggattgcagtggcacaatttcaactcactgaagccttgacctcccaagccctaagcaatcctcccaattcagcttcctgagtagctgggactccagacttgcaccaccacgtccagttaattttatttttttttgtggagacagggttttgctatgttgcccagactggtctggaactcctgagctcaaatgatccccctgtcttggcctcccaaagtgctgagatcacaggtgtgagctatcacacctggcccctgctttcaattcttgttccatgcttttatattttattttattttatttattttgagatagggtctcgctctgttgcccaggctggagggcagtgtccatgctttattttttctgcagagcactaattaccaaccaactgccctcctcctgcccacaactagagatgcaaatgatttctatttggtagaaagataaccctaaaggttataattgtattgccttaaggacattagccagttttgttttattttattttattgttgagacggagtctcgctctgtcacccaggctgtagtgcagtggtgcaatctcggctcactgcaacctccgcttcctgggttcaagcgattctcatgcctcagtctcccatgttgctgggattacagatgcccaccactatgcctaatttttgtgtttttggtagaggtggggtttcaccacgttggccaggctggtttcaatctcctgacctcagatgatccacccgcctcggcttcccaaagttctgggattacaggtgtgagccaccatgcccagtcgcaaccggttttacttcaaacctagtaattttattctaacattcttttaaaaatgtctataaatacttaggtcctccaaatactttttggaccagctttaccatcttacttgtttcatcattaatgattaataaatctctgatatgtgttcattccatctttgttatgggagttatgttttttaacttttaaaaaagtatgcattggcatctagaagtttttcccaggggctaaaatctgcttttggatgaaattcagtacatcagtagtttaggacttcgggtgtttgggggcgacctgcactaagccatgcaagtgcgtgcggagcctcttgagttgtggctcccgttggtgtacccagggggtctggaaattccaggaagcttatgaggacctggatctgctgggccccaggaacggccagtacttcctcagcaaccactatgcgccatgcacattctgaaagctttctatgtgttagcttatcctcacacggtctccctgagataaacactagtttgcagatgaggaaacaagctcagagggtttaaggaactctgaggatcacagtttaagcaaaaattatagaagaaagacctaaataaagtggttctatgtgcatcaaggtggttaaatggtttttttctctagttctgcaatttcatctaagatcaaagccaagagggggaagctaaggtatagtctatggtaggagcagccttgcctgtgggggcagaccacacccacacaggcagataccatccatcaggggactgtggtctcctgtgggacagacagacttccagggagcttgctgagaggtgccagttcaaagactagaccctcccaccagctgtcttcccaccgtcatcctggtgatgtgagaggggtgttgtcattggcgggggatgggtgcagaattcaggaaaggagctacttactcgccactccactctgggaggcaagggaatattgacctcgtcaagggaggcgaatcccaagagcatcactgtgaaggctgggggcctgtgccctccacttgcctccccacacactgaactgggtgctggtaacgtcttatctacatgtggccgagggaccggaccagcagaaggtgtggtgctgtgggtggtgagagagataataggaagcaatggctctgggatgggcaggggagagacagccaggggtgcccctcccttcctctgagggtgaggaggatggttgctggatgcttcaggagcttgctggctggggagatggtggctgcaggcggctggggacacaacctgtgtggaagaggtgtgcactttagaggtgtgcacagattggtaccagtctgtggcctgttaggaactgtgccacacagcaggaggcgagcaacaagtgaacaaagcttcatgtgtatttacagccgctcgccgtcgctggctcacattaccgcctgagctccgcctcctgtcagatctgcggcagcattagattctcataggagtgtgaaccctatcgtgaactgtgcatgcgagggatctaggttgcaggctccttatgagaatctaatgcctgatgatctgtcactgtctcccatcagccctagaagggaccattgagttgcaggaaaaccagttcagggctcccactgaattatacagttcaccatagaattgtgaactgtataattatacaattctatggtgaattgtataattatttcattatataacaatcagagaaataaagtgcacaataaatataatgtgcttgaatcatccccctccgtggcacccggtctctggaaagactgtcttccatgaaactggtccctggtgccaaaaaaggtggagactgctgctttagaggactgtggctaaggggtcagctggaagatggggcccagggctcagggaccctgaatgcccggttgctgccaattgtttgtcttcattgatctcctggtcagtggaccagatcagcagaatgaaccagcaaggcgaggactgtgaccttcccaagggcaactcttaatgtaggggaacctctgtgcacctcctacccatgccccttcccataaagggactcaaagaaggagacagggagggagggagggagctgagagcaagtcccgctctcctaggccagtgctcaattccagtctggggatggggaagtagggcagactgatttgaataagagatgtggtttgcaaatcaatggaagaaaaccaggaaggaaaacattataagaaccaaaagagacccaaaagtctaacgctgagttcatccgtgtgcgatgacaagcctgtcccaggtgggtgcaggtgggagttgttggaaagctgagcataagtgcttgaaccctctgtgcccgtttcctcctgtataaaatggagacaatgataatacaggaaaagcttctacctcttagaggtgttgtggggagttaccaagttcatctctgtaggatgcttggcacatggaagttactataaagactagctgccattcttcaaattgtgacttccccagacaccagttcaatgtgctttcttcccacttgattcaatggcagccgtctcggtggtgggacactctgcttgctgtgaggaggatggaggagaaggggctcctcggggccaggccacaggaccctcaggataaggccctgcctccatgttcagggctttcagcagctacagacctgacggggctgcaaaaagctttgcagggaagatgggggaggggtgtatgcaaagaaaaagctgacaagcagtctgctttggaacagggctggacactctgtgttggggagtccagggcccccagcatgcccccggcagcagggagggcatgcctggcaaccttcaaaaagtgaatttccaaagagcaccaggaggaaaccttccagaaccttctcacagaacctttggatgggcctctcagggcgctgttttccaccgtccacttagatcttagtcccttacaaaaaggtacctcccttacgggagatgactgaggtgggggagaattaattcctgttttcctgccctcatggaggatgtcaagtaagaaatccggagaatttctctttctccagttcagtgtgctcaaaggagacccacaggactggaggatcaactgggacaggagaacagagcctttcttgtctaaaaccaagtcagttccacagaataaaagctcatttagagaactcctgggctctgggcgcctatagggtgggtaggagctagtcagtcagtctgttagggaaaagacaaactcatcacatgatcccaagccttccctgcaacaagaagacacttggccaggccaagaggtgaagttcttgtttattgttgcagcaactcttatacagacattagcgttcagttaaataaaggaagatagatagcacagtaaatacatcacaaccccaaactggatgactgtggccacgggacggaggagggagggagggagggaccagtgaccagactgtcaaggaagtacattcagtgggtgtgcggtgtccacattccaggctcacgtgtagatatattttatttatatatttatttatatttatatatagatcattgagttttgtgtatacaaagaacgatattgttacaaatacaatactatacttctcccgacactttacaataagctctatttcaccctctttacagaacaatagtacaagttcatactctaggtgctgtgctaagtatgtacaagaaatgtcattcccacacagtcctcacacactgccttgatggaggggaagaaagatcgagttgtgtgctcaagtcaacctaggccagggaaggagacacatgaaactcaaaccaacaggtggcctgtgaatgcgagtaaacacatctaaggaggggcggcccctggttgtaaacattggtaacggctacaccactgggtcgagggacccgggaagggctctgtagatggttttcatctgtgtgcgggaggtgttggtgcccacagggtgaggggggcagaggagcgatgggggaggtagtaggttactctgggactccctgaaggcggtgttgatgggcaatgttcagaaagcaaacccgtgcacagggacccggcacccctgccatgcactcctaggagcctgctctggcgagggaaggtgtcgctggagaagtgggctccaggcattggtctttgggggtttcttcctctcatgaacccaaggctgatggtggctccctgaaatgctcacactggagaaaaggcaggatgggttctggtgcctctgcctggaccaggagggggaggtgaacgtgggagtccaaccccaaagctgagccaccagcacaccctggtggagcagccacagcagctctgtgccctcacagcgtttgggaaggctgccctgtacatagccttcccattacatggggtatttagatatttacatgtataactatatatactgggatgacagaagggaagaccaccacttctcttgggactttcaaaaaatctagcgacttgcttttaagactgtggctgctgaggtgaccatacctaggctcactcccttgccccagtggtagtgggaaaaagaacccacttcagctgggtggacctgtaccgagctccagcaacttccactcactgggtgtgaagacacacctggattaacacaaaagaatgtggcagagaaatcttctcactctaatgttacaatgtcagtcctctaggagagcttgcagaattggctttttcagcacctctcaaagtttacaaggtttttgtgcaataggaatagaaagtatattctctcctttaggtgaacatacataaccgttatgtgcaggttgtacagggatgcactactggagttctgtcccctggccagtcgtgggcgggcctctgtggcactgcccaggtgcctagggacagacaggcatgggcccctacgatgattttccaaggctcctgatgcctgaaataccaccagtaacacttcattcctgttctatccactcttattggcagaggaaagatgaactggctgatgactctttagtgtctcactgtatcaccagatactctacagcaaatggagaaccctggccatggttccttcctggtcctcacgtttgtgatgggttgaccttgaggctggtctcccagaaacattctgtaaagcatccttcaaagaagtcctggggagctttacggaccatcccagagcccctggccccaccgggtgccactctctgcagcagcagaagtccctttccccccagggcacctgggcagccagcggcctcccttcctcagggctcctttgtaacacagtgaaactgagagtgccactgctcgttcctgtcaagcactgagcttccctgattctaagcagaaaactcagaagatgcagagatctcggggaattgatcacagaactctctggttgaagtctcttgtccctaatcttgttatagtcactttgctccctccttagaatccctccattctctctataaatacatgctacccaccatttgctcactgagttcctatttccatagacacaacataaatatctcggatgcagagaacagggactatattaattacaaaatataatagtttctcttcccctgtctctactgaggtcatgaatgaaacaaaacaaaagcaaagccaaatcacacctcacatgaacacaaaatgctctttggaccaagtgaaaactggctcagaattataatattactaaaacatctacactgaactgagacggaagcataaatatgaggcacctgatgaaaacacggaacaattccacaccagccaaaaatgctctcaggcccacaaggcagcaagagggtgtttatggaccacatctggggattctgaggcataacttgaggttgctattgtctccttaattttgtggtttatgtactattctggcctttccaatatcacatccgcctagtggccctgagcagagaagaaagttggtcttgccttgggccagaaaacaagacgcaattgcacctgcagcttgccttcttgggaacagtccctccttcccagactcctgggatgtgtgttcggcagggaggggagtccaggaggaggatgctttaagccaaagtggtgctggaggggctgggcctcagcgcagagagggcaggtctctcaggatgaggctgagcagcccccgcctgcctggccacctgccagggaaggggccttccagagaggtgggtttccaggggatctgtgtgcctaatcttcagcttgtctcactggtggtgggagcagggaagggtgatatgcaaatgggactgtgtgtgtgtgtgtgtgtgtgagagagagagaagcagacagtacctgcctgtgtttatctaatggttgataacttgaggacaacctggtaaagcttcagatgccccatgaattgccaagctctctgtgacactatggtgtccttgcccaaggcagttatttccccttttatcctggggtgagaaggctcgtattagaaaacacacatacgttgaaattagaactagcaatagaagaggtttaaggttggctcagagattctgggaagaaataatgtatggtgccccaactacatggcaggcagtgcataaccttaatgacgtgggctggccctgggtactaccacattcccacagataaactcagagagcagggatcagcaactgggttttaggcactgctgaatcagctgctttgctgccccgcgagctccttttaagaagtctgcacctcctgggaagggaggattctccctcaagcagtgacagcccaccccctggacacacccagaaagccctccaggatggtcctgggtcagtaccaggtgggtgctggctgctctccatcctcaagggagtgcatacgaaacttccctggtattgaaaaaaaaaaaaaaaaaaaagcaaatcggagagagtaaagaggtccttgtggattcttctcttcctgtgtaaaaccaaatgctgggcgcgagaggggaaagtctcagtggacacagggatgcagcacgagaaacacaaccacgaagaggagagtcctccatgcatgccaccgcgtgtggccgcggtcagatgtaaacaggctgctcctgggccgtcagcagcctgtacatcgcggctggcattgtcttcatatgaatctgagggtaaagaacacactttagtggggggctgaggctgggggctggctgcgtgggcactgcccagggctggccagagaggcagtgcctctcccacagagggctttgaagatactccctaccgcccagccaccaccagggacctgacccagggtggcctccaggaacagtggaatccactgactttctcaaaagcttaggggtgacagaaatgaacaacaaaaaccaagcaaggcttatttctcagtcaaatgctctcgctctcaccagaccctacccttttaaaagcaagaactctgaaaatggaggaagggctccaggcttctcagggtgcctgcctccctcatctctcttggcagatgaggcaaggatgacaaatcagccctagaacagcagtgatgattgatagcagtgatgaatgacagcagtgatgactgacagcaatgaatgacagcagtgttgactgacagcagtgataaatcaatgacagcagtgatgactgacagcagtggtaactgacagcagtgttgactgacagcagtgataaatgaatgacagcagtgttgactgacagcagtgataaatgaatgacagcagtgatgactgacagcagtgatgaatgacagcagtgatgactgacagtagtgatgactgataggagtgatgaatggcaacaatgatgactgactgacagctgtgatgactgacagtaatgacacgtcatgccacactgcactggggtcacacctctggaaggccactttgttgattcaacttgagtctaagacttaaatcttttaaaaacatttggggagattaactggggaaaatggaggcaacttaggcggccatacagaaaagcaacagaaagctgagtgttaaaaagagaaggtgagcacatcagatgaaagagaaggctgagggtgatctgattccatttcatggaggagctcccagataactgcttgctaatgggtttggcatttggtcagagacaggtctgcttgttggggagtgttcaggattggaaactcagggagctttcctggaaggtctgctcagggccacggtgagcatacgaggcaggggcaccagacgcggccctcagcaccaccctcagccccggacctctcctacctccccaacagcattggagagaatgtggacgatcttctcgtggggggtggccacgacgctctgtccattgatttcaatgatccggtgccccacacggacgcctcctctctcagctattccccctcgcatgaggctgcagatctgccagagtcaaaggcagagttaccctcattgcagacagtgcggtggggctggaaggccgtctttcctgaaagccccctgcccctacactctgctcttggagaaactgacatggttaggctttgggcatttaactctcttagtgtcttttcacaaaaaaataggtgccgtcggcccacatggccaccttgttcatgcggcttgcacagagactgtagcacatcactggtttttacggcacactgaattctacttctcatcccagctggggctgggtaaaaagggccatttgggtctgtcgcagagtcgccagtgtttccaaactgtcagcctgtgtgacacaggttagtgttagttcccgtagtcatgactgggactcaagcactgaagcgtttaatgccagcagactgtttttagggtcacgattgcctgagccaccatggggctggaactccactccgtgttccaaagtgtggctggctggaggggagagactccttcagagtttcccaattcagcggcccctgttcaaactcccttcccacagaaaagacagtgaggctggattttgtgatggcacagccaggtaccacagtgacccgaggttgcaggcggggctgatgcgccctccacccttacctcacacacactacaacataacttttcccaaaagagtaggtctgaatttactaagttggcttttcattccagaccatgcacctttatttaaaagtggatgcagacaagattgcaagtgacatcttgcagcaacatgctgtgtgattctgagtgtgtggcccagctgctctctcagctagtctggggtcaaaacattccttaggtgttttcccagtggacccacacatgttaacaactccttgttcgtatctgaacttttaatgcagtttaactatgaacaaagcaaacaagtacaagtacaaaccaatgaaaagatgatctcagagctaaactgtaaagagtcaccctagatcctctcctaataggcaaattaggctactcaggtacaaagaatgcaggaagtggggctggatatttcaactccaaatgggaagttcaagggtatttctaaaccttcaaatgtatttggaatgatattttaattacctaggactttttttttttttttttttttaagacagagtcttgctctgtcacctaggctggagtgcagtggcataatctctgctcactgcaacctttgcctcccgggttcaggtgatcctcctgcctcaccctcctgagtagctgggattacaggtgcccgccaccacacctggctactttttgtatttttagcagagactgggctttgccatgttggccaagctggtctcaaactcctggcctcaagtgatctgcctggcttcgccggaaggccaaggtttgaaggatcactcaaataccaaactgttcgagtcccaattgtgactgtgggaactgagccggcccctgcactgtacagccccaggcttgggagtcagctgctctgcgggactctgtgcagccagggtggacagtccagaggcaaggaggctcttggagggtgcatcccaaactctcaagctggcagccgggaaggcagtcctgcatgtcacagaaacactgggttctgggtgggaatctctgctgaagggactctgtccagagagggagctgagcctccttcatccactcatactctt

SEQ ID NO: 44 - DNA, 17083 bp, Homo sapiens
acacatcactctagttagtgttacaaagaggtttgaacaaagataccaaacgaagcatcttgtggcacagtttaagaaatgactcaactttctttgagggcctcctcataatcactaaatagttttaggaacagtggggctataaagaatgtatttcatttcatgaccataaaaagaggcaggtgaaggtcattaacatcttcataggactagaaggaacgttctgctcccttggtttcataaactgccaccactatttaaggaactcctatttacttagacttaatctaccctgaaaaacacacagaaaagtgatctctaatgattccactatgttcttattcccaatcacatgtaggactagaaaaatgtcctgataaataaaatgaagaaattaatttggaagatatttaaggcctgcttttgccttagtctgtgttttctgtgaacacaaacttctctattgggagtagttgacagtgataatataagctaagctgggaaaataattaaatgaatttcggatttgagacgtctctaaataaaagctcacttgcaactgaaaaaaaaacaaaaataataacgaaaacaataatatggttgttaaaatcctatgctaagtgtgtccaatgttctttatcacattggtccacctactgtaattcacctgacttaggattttattagaaatgcaaactctcatgtctgacgccaacatactgaattcgtatcggcattttaacaggaccccccagatgactcgtatttatattaaagtttgtgaagcactgctttacagatcagttgtttcacggaaattatctaccagaatggaaattgtatttttcataggaaaaatagaagccctatgtttctgccatgcctagataaaaaagtgcattataacaaaaaataatacctttttttcagaatgctgagaagtcacagcagcaatagcatcaactataaacttcttagaaatataaatcatttatccccatcccagacctactcgatcaaacctctgggcttgggcccaggaatctgtttgagcaggcctgacattattctgatgcatactgttgcttttagagtgggagatgaagactcaccagatgtagtcaatcagtctgaaagtcaattgactagttaccaaataaaagggaaatgtaagtttcaaaaaggggcttagatggaaaatggacttttttcatgaacaatgccaagttttaaaggattaataatataatacatgtgaaatagatcatggttgctatattttctgcaatgtcataaatccttgtctttcaaaactcatacaaaatattagctccttcggtaaactcatttcttaataacagtaactttttgctgttctgaactcccatctccatcatctgtattgaccatgtggtgatttttactttccaaaaattgttaccagggaccacagaggaactgctttctggagtagtgtaatgttctggagggtaaggtttgtgtcttgtacctatgtaacccccagccacctatatctgcaacacagttgatatcaaatatgtgttctctatttaaatgtttgttaatgttttaatttcgggatgaaaaggccagtatttttgcttgtttctttctggtttggaggtcattttaattctttttaaaagatgagtaactacctgtaaaatacattgagatctcttgattaaaagtaaaagctatgtaaaatacatctccttttacatattcagcattttttaaaaaccaccagcaaagtcacagaaggtcttctaccccccagtagtacaattgaaacatctgacataacataaaatatgtctccattttcatgcatttaaatttctaattgtttctcgatcccttggagagcttttctaggtcaactaagtactcacactgtgctacatgttccaagagttcaagttagccttttctctgtaatcctcaaaaaacagaatgctaccacatgctcctcatttatacaatcgttagaaaagatcctaagaataatttgattatttgactgtcaaatgcaagcccttacagttgtagatgtctgtttaatgatgttattcctagctccttaacatttaatatttgcctcttcttgtactttagtttctaatccagatttaatcctgaaaaaaactttttacaaggtaacgaattgttgaaaatacagtgacacaatcactgattcctcactttcaattcaaagaaatgattaaaggaagaaaaagatgaagggagagccacaggagttggaatcgctgtatcagctcttcggaaacagtatcaagtcccattcatgtcccatgaccttagagggtttcggtgagatttaatgcagcaggaatgagatagaagaaagaaaacaatggctgactcagaactactccatctgatttagataagattgaagcaaaatcccatgaaaatgaccttgtttgtaagaatgaggaatggaggtgaggtgggacagtagcaagggctccaggaggaacccctttaaccactgagctcccaccacttttttaagtagctgcctggaggagctgaggctgagcactgcctttgcttcgggctttggctaaaacacttgcctgaagcagcaagaagactgcgtgctgtacctcaaattcttgccaggtgaacagaaaaaaaaaaaaaaaagaaaaagaaaagaagaacatcagtttaagtctggcctggaaggcacatcaaaggcagaggtgaacctaaactgcaggcagaagatctttctcctcacatacccaagggactggtcccttcctttgcctctaatgctgtagaattcttgattcaacagccccttcaaccaacctcacatcctggaggactctaactctatgtgacgatgaggagtttgagggacacctacccaggtgatttttgaggaaagctgcagtccagcgtttctcttatcaaaaagagagggataataaaccaaaatagacatcaaaacatagggagtaggtatgacacaaatgccaagatttaagggaattatgtaagaatggtgttatggaccgaatgttgtatctccctaaatttctatgttgagatcgtaacacccaattcgatggtattaagaagtaagacctttgggaggtaattagatcataagagtggagctctcatcatgggaccagtgccattatcaaagaaacccggagagctctctgactctactcttttccaccaaatgcagacacattgagaagacggccatctatgaaccaagagggaggacatcagatcagccaccatttcgatcttgaacttcccaggctccagaaatgtgagaaataattttttttaattaaagccacccagtctagggtactttttgttatagcagcctgaacagactaagaaaaattaaatgggaaagaagtagtgataggcaaagagaataggaaactgagcaatgtctaaataaaagttggtagtctagtactaaaataatagaaaataaatgttgaaagggacaaatatgttttaaaaatcataacctagttgtaaaactgaacatgacagtctcaatttgaccaacctttggacagatattttttttggcctataagcccctgacctccatttaaaggggcattaacttagaaaacttacaatttgaatttctttctccactcctttgaggtacagtagtgcccacttattcacatttttcctttctagggattcagttactctcagtatagtacaataagacattttgagaaagagactgcagttgtataacttttattacggtctgttgttatagttgttttattttattagtaattattgttgttaatctcttattgtgactaatttataaattaaactttatcataggtatggaatatataggaaaaacatactatatatagagtttgggtctactaccatatcaccctgtatgcgcctgatctcatctgatctcaaaagctaagcagggtagggcctgtttagtacttggatgggagtctggtactatctatggtttcattcacgaattgaaggtcttgcatgtatcccccaaggataaggagtactattgtgtgccttttccctaactcttgccaattttacaaaccaggaatatctttctcaaggacctgggagacatctctttgaaatgtaatcatcaggaataatggcgcctctatcttccagtctctggggaatgataggagcctaatttccataagccccaagtagcaaacccagatggcctaatcacatttatcattctccaccataatggcctccagtagtttttcactagctcagtccagggcttacacacttttctgcctttgcttccagcaaagttctgtttaatttttctctcttattgcagtagtcttaaataaactctttcttgccatttaactttattcagtacaattcttctttgacaaaactcataacatttcagtgaaagctagtatattatgcagtatatatgtgaaaaagtaaaatcacacatttttcattatgatttcatatagtaaagtgatgtcatttatcattctagaagttgaatttaaagaaaaatgttaattttagataaagtgattcaaagcaaaggaacaactaaaaataaaaaataaataataaattattaaaattccccttaaattaatttaaaaataaatttaaaatttcctaagatgtaatctttacacagaaaaacacattaataaaatatataaaatcaaaaagattttaggaagaagtaaacaaatagaaatctaaagagaaattgaacaattcctcaaagtttttggcattttttttttttaccatgtagacaaaattacgaataatggtagcagaggtttgatcctggaatcaataaattttatttacctggtataacatatttccagaattcttaaattccgttaatgataaatacatcttcaattgagataattatagctgtttgagaaaaaaatatatagcggatctttgaacaatgtgcggatgaaagacaccacagtcaaaatccatatatatcttttgactacccgaaaacttagctactaatagcctacttttgactggaggttttagcaagaacatagtcaatatatattttgtatattatatgcattatatgctgtattcttacaataaagtaagctaaagaaaagggaactttttttttttttatttttagtttttagatggagtcttgctctgtggccaggctggagtgcagtggtgcaatcttggctcactgcaacttccaacttctgactccccggttcaagcaattctcctgcctcaacctccctagtagctgggattacaggcacgtgccaccactcccagataatttttgtatttttagtagagaaggggtttcaccatgttggccagtgtggtctcaatctcctgacctcgtgatctgcctgccttggcctcacaaagtgctgggattacaggcatgagccaccgtgcccagccaataaaagagaacattattaagaaaatttaaaaaagacaaaatatatttagtattcattaagtgaaaatggattatgataaagagcttcatccttattatcttcacattgagtaggctaaggaggaggaacatgaggaagggttggtcttgctgtctcaggggtgacagaggcagaaaaggtagaggaggtggaaggagaggcaggagagtcaggcacattccgtgtaactttatggaaacacatcataatttctgtctgacatttttgctttctaatttctctaaaaacatttctatagagtaccaatatttttgccactgtttgcgtaagtttcagtacttgtatcataggagtgttcacgtagtaaacaaagtcaaagttagtcttaaataattgaaatccttttgccagattgtctaatgtaaatttgttttctggcattgcttcttctatgtcttcttccgtagcaggtactggttcaaaagcactcatctccataaagttgtcttcttttaattcctctagtgtggtgtctcttagctctcgaatttctccaagatacatatcttgaaaccctcccctgactttttgcatatccattatctcttcatgatttctttgattggctctatcataaatcttatgaattcattcacaacatttagacattgtttcttccagcaggcatttattgttttgggcttgatggcttttgcaattttttctgtaagtagcatgacattttcaatggtgtaatccttccagactttcataatgttcaatcatggttatcttccacaacattggcaatcctttctatatagtaccatgtgtaatgagtctgaaaggtccttatgatcccctgatctagagattgaatcagaaatgcatttgagggcaagtagaccatgtagatgcctttggtgctgaactcatgaggctctgggcagccaggggcattgttcaatatcaaaagaactctaaagggcaattatatactggaaaggtattttttgacaatagggacaaatcatcaatagaatcaatttaaaaaaagagttcttgttgtaaaacagaccttcctgttttacaagcaaaagactggcagctggtgtttatcttttaccatcaaggctcaggagttagcagctttatagataagtgcagtcctggtcataaatctgactacatttgcacgaaacagtggagttagcctatcccttcctatgttaaatcttggtgctcatttctctctcttttttttaaatttatttttttattatactttaagttttagggtacatgtgcatattgtgcaggttagttacatatgtatacatgtgccatgctggtgcgctgcacccactaactcgtcatctagcattaggtatgtctcccaatgctatccctcccgcctccccccaccccacaacagtccccagagtgtgatattccccttcctgtgtccatatgatcttattgttcacttcccgcctatgagtgacaatatgcggtgtttggttttttgttcttgcagtagtttactgagaatgatgatttccaatttcatccatgtccctacaaaggacatgaactcatcattttttatggctgcatagtattccacggtgtatatgtcccacattttcttaatccagtctatcattgttggacatttgggttggttccaagtctttgctgttgtgaataatgccgcaataaacatacatgtgcatgtgtctttatagcagcatgatttataatcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacatcctctccagcacctgttgtttcctgacttttgaaagattgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatagggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcattatttctgagggctctgttctgttccattgatctatatctctgttttggtaccagtaccatgctgttttggttactgtagccttgcagtatagtttgaagtcagggagtgtgatgcatccagctttgttcttttggcttaggattgacttggccatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcctggagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattatgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtctattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctgggttagtcttgggagagtgtatgtgtcgaggaatttatccatttcttgtagattttctagtttatttgcgtagaggtgtttgtagtattctctgatggtagtttgtatttctgtgggatcggtggtgatatcccctttatcattttttactgcatccatttgattcttctctctttttttctttattagtcttgctagcggtctatcaattttgttgatcctttcaaaaaaccagctcctggattcattaattttttgaagggttttttgtgtctctatttccttcagttctgctctgagtttagttatttcttgccttctgctagcttttgaatgtgtttgctcttgcttttctagttcttttaattgtgatgttagggtgtcaattttggatctttcctgctttcttttgtgggcatttagtgctataaatttccctttacacactgctttgaatgcatcccagagattctggtatgttgtgtctttgttttcgttggtttcaaagaacatccttatttgtgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcatgtttggaataggtgtggtgtggtgctgaaaaaaatgtatattgtgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtatgggagtctaagtctctttgtaggtcgctcaggacttgctttatgaatctgggtgctcctgtattgggtgcatatatatttaggatagttagctcttcttgttgaattgatccctttaccatcatgtaatggccttcactgtctcttttgatctttgttggtttaaagtctgttttatcagagactaggattgcaacccctgcctttttttgttttccattggcttggtagatcttcctccatccttttattttgagcctatatgtgtctctgcacgtgagatgggtttcctgaatacagcacactgatgggtcttgactctttatccaatttgccagtctgtgtcttttaattggagcatttagtccagttacatttaaagataatattgttttgtgtgaatttgatcttatcattatgatgttagctggttattttgctcgttagttgatgcagtttcttcctagtcttgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgcaattctgggttgaaaattcttttctttatgaatgttgaatattggcccccactctcttctggcttgcagggtttctgccgagagatccgctgttagtctgatgggcttccctttgagggtaacccgacctttctctctggctgcccttaacattttttccttcatttcaactttggtgaatctgacaattattgtcttggagttgctcttctcgaggagtatctttgtgttgttctctgtatttcctgaatctgaacattggcttgccttgctagattggggaagttctcctggataatctcctgcagagtgttttccaacttggttccattctccccatcactttcaggtacaccaatcagacgtagatttggtcttttcacatagtcccatatttcttggaggctttgctcatttctttttattctttttcctctaaaccccttctcgcttcatttcattcatttcatcttccattgctgatacccttttttccagttgatcgcatcggctcctgaggcttctgcattcttcacgtagttctcgagccttggttttcagctccatcacctcctttaagcacttctctgtattggttattctagtaatacattcttctaaatttttttcaaagttttcaacttctttgcctttggtttcaatgtcctcccgtagctcagagtaatttgattgtctgaagtcttcttctctcagcttgtcaaagtcattctccatccagctttgttccgttgctggtgaggaactgcgttcctttggaggaggagaggtgctctgcttttcagagtttccagtttttctgttctgttttttccccgtctttgtggtttttatctacttttggtctttgatgatggtgatgtacagatgggtttgtggtgtggatgtcctttctgtttgttagttttccttctaacagagaggaccctcagctgcaggtctgttggaataccctgccgtgtgaggtgtcagtgtgcccgtgcttgggggtgcctcccagttaggctgttctggggtcagggacccacttgaggaggcagtctgcccattctcagatctccagctgcatgctgggagaaccacagctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgttcaatggcgggcacccctcccccagcctggctgccgccttgcagtttgatctcagactgctgtgctagcaatcagcgagactccgtgggcgtaggaccctccgagccaggtgtggcatataatcttgtggtgggccccttttttaagcccgtctgaaaagcgcagtattcgggtgggagtgacccgattttccaggtgcggtgcatcacccctttctttgactcagaaagggaactccgtgaccccttgcgcttcccaagtgaggcaatgcctcgccctgcttcggctcgcgcatggtgcgcgcacccactgacctgcgcccactgtctggcactcccaatgagattaacccggtacctcagatggaaatgcagaaatcacccgtcctctgcgtcgctcacgctgggagctatagaccggagctgttcctattctcatttctcttattgataaatttcctttgtggcatttctattttttttcctgaagaggacacttttttatctgcattaaaaatctattcaggtaaatattttttctcctcaatggttttcacaaattgtatctgaaaactcatctgctgcctcttgatcatcagaagctgcttctgctgttatattatcttgacatttttttaaagccaaacctctttctaaaattgtcaaaccatcctttgctgacattaaatactcaggctttagatctttcaccttccttttgctttaagttgtcatagaatgacttcattttttcctcaaattatattagagtccatatgtatgcctttcttatagctatcttgcacccgcataaaagctccactttaaataaaagataaaatggtattttgcaacacatgtaagatttacgggcctgctgatgttgctgcagcgatggcttcacaaatttcctttcctttttttacagtggtccttacactggattcatttatcttgaaatgtcaggcaactacagctacagatctaaatctacagtacatatcaagcaattcagctttttcttgtaattttatgacttttctttgcttgggagaagttccagtataactagtggtgctttctttggggtcccatgatgttatttaaggtttacgatattgcactaaacatgttttaagcaaatattcacaacacttgagctcactgcaatagcaacaggaggtgactatgaattattacagcagtacagtaataaattgctgttggtaattttaagcagttatgatttaatactgcatctttacatttgtttacattttttaaactgcaaatgatgccctgcacgggtctgtgcttttttgcttacattttgatacctgttaactttttctgatttttttctatattttacagtttgcattttcaaatcgtcacaaatctccaatttttcaacatatttattgaagaaatccacatataagtggatccacacagttaaacctgtgttgtttaagggtcaactgtttaacacctacaagtacattacattgattttaaattagttacgtattttagaaaatttaaatcgctattggggaagtaatttaaattatagagtgttctttagaattaatcaaataccatataacaaattgttgaagcttttattcaaagattgtagatttcttaaaaattccttttaatctttattcttgttcagccatatatatatatataaagctgaacacacacaccttagagatacacatgcttaggtgcaggaagttgcagtacaagaatattcagacaagcattagttacaaaattatcagagttaattaatattgggaagaattcatattccaccaacattgaatgaataaatatatcacattattttcctcactaccatgactcctaccccatagtaagcagtaagctaaatgttgtgttttcatcaggttacgttggtgatatctgggaatccacctttccatacatgaaaacaatgccaattttaaattaaaggcaaataatggttggaaaagtcatttgtgttttatttagtatatttttaaaaactttttttaatggtaaaatatacataacataaaatgtaccattttaatcgtgtttaagtgttcagttttgtggtgtgaaatacatttacattgttgtgccacatcatgaccatctacctccagaactcttcatctcaaactgaaactctgtacctattaaggcgtaactccccgtattctccctccctggcccatggcaaacgcctatttagtgtaaattttgaattaacatgctaatgtgaaaagtttctctgaaactaaacaaggaaattaattgatttaatcctgaattaaaactaattccgggtaaaactcaggttactgaatttatgaatttcacaataccatttggcatccctatttcccgtacaaaccttttgctccacttggatatttcttgcaagtactttgcttatctgagatcagacaagtaaaaaagaaattcagcagtgccgtatattttaattgcaatgttaattctgcacatttcagagtaagatgggagaagaatgtgtatgatttgacagtataaaatactcataataaaactgcttggtaatatccagatgattcattagtaaaaatgtagaactggagggttaagaaaatgtttgaatgttaaacagagttgctacttgaattttctatgttttattgtgaaagtgagaaaacataaataattatttttggaaaattatttttaaatgttgtattttgagctaaaacaatccccaaattcatgatatattaatatttatctgttttaatgttcagtggtggctgtaattgtattacacacacaaaaaggaagcataggtaccactagattaatgtttttgagaaagaatccaatttcttttattaaatacattattcagataaataaatcatagtacattaagcgatgctttataatcctatgcatactttgaaaaatattatggaaaagcatgcttaatatcatgagaaaatgttcatatatatagtcaaatgggtgcaagattgctataagaaaggcatacatatggactctaattactatgctaccattaaaataatttgaacacacacaagtacatgtctacatatacatagatatattatacatagatatatgaatgctgtgtttttctcactgggtgataagattaagctgatacttagatttctcttttgtttcccacataaagtaaataaatgcaatattttcaaactaaagtatcctatgtaatttcacttaagttgtatttactatggggcaccactgattttgaaatgatcaatgtaatgttctctttatttcatgcatgaatagcttcctaagttcttattaatatcatttttacacatctgaacacctttataaaataccgtaactgtgctggccagtaatgttgtcaagattgaattctttttgtatggttttttatttatttgttttcacaaaaatgaaatactaaatataccttaaaggaaactaactgttcagcccagcatgtagtgaatgctttgatcatagaagcagttattttacacaaaattaattcagttcgaatagagattcacaataaactgagtggcagattgcacttcagaatgtatcacaccaatttaggactttcattttatccaaatttcatatggaaaactttctatagttgtcactcttataatatgactgtatgaacattgaatctagtctgcaataaactattaagatgtgagtcctccaaagatatcttgctacaccgatcttgaagaaggaagtacaaacaattaatttaaaatgctgctattgtgtttgtattggcatttgcaattgaatagtctgcataaaatttaggaatgaagactttaataactgatttgcagtacttgtattgagaaaataattttctcaaatgtgggactacagttctgctcctcaagtaaaagcccatgaaacaagatctgataaaattaataataagaaggattaagcaaaatagagcatcaacttataacagtgtactttataatcttatacatgtatttattaaactagctcaggagcacttccagtaaaggcacatttaatgagagtgaattttagttgagatagaaaagcagatcatatgggtacgtcagtctctaatcaactttttagtggtaatccaggaaggatcttcaatttaacttggaaggtgtttctagtgtttagattttctcctagtaatttaacctgaacatatgtttgtaatagctttcttcataaaaggccataagtagggtaagtagctagatagtatatgttaagatattaaaataagacttttttcacccttctcatatttgtataattaatatgttgccaatatttagtggaaaataaaattgattttgatgtatgagaagcttaacaatccatatttaaacttatagcatggctttaagccatcatgttcttggctttatttataaagatgggtattttaaaagacaaggatcagccagacctgcagagttgcccaaggaagaaaatgccttgtgtgtaggccgaccacaaacaaaatgagccatgggtagaaatatctgcagcaaaaggtaatcaattgcacttgacggacttctgaacaatatgcaatttaactcaatgatacctagctgctcctatctttttaatagcttgtgaattcagaag

SEQ ID NO: 45 - DNA, 8941 bp, Homo sapiens
acctggtataacatatttccagaattcttaaattccgttaatgataaatacatcttcaattgagataattatagctgtttgagaaaaaaatatatagcggatctttgaacaatgtgcggatgaaagacaccacagtcaaaatccatatatatcttttgactacccgaaaacttagctactaatagcctacttttgactggaggttttagcaagaacatagtcaatatatattttgtatattatatgcattatatgctgtattcttacaataaagtaagctaaagaaaagggaactttttttttttttatttttagtttttagatggagtcttgctctgtggccaggctggagtgcagtggtgcaatcttggctcactgcaacttccaacttctgactccccggttcaagcaattctcctgcctcaacctccctagtagctgggattacaggcacgtgccaccactcccagataatttttgtatttttagtagagaaggggtttcaccatgttggccagtgtggtctcaatctcctgacctcgtgatctgcctgccttggcctcacaaagtgctgggattacaggcatgagccaccgtgcccagccaataaaagagaacattattaagaaaatttaaaaaagacaaaatatatttagtattcattaagtgaaaatggattatgataaagagcttcatccttattatcttcacattgagtaggctaaggaggaggaacatgaggaagggttggtcttgctgtctcaggggtgacagaggcagaaaaggtagaggaggtggaaggagaggcaggagagtcaggcacattccgtgtaactttatggaaacacatcataatttctgtctgacatttttgctttctaatttctctaaaaacatttctatagagtaccaatatttttgccactgtttgcgtaagtttcagtacttgtatcataggagtgttcacgtagtaaacaaagtcaaagttagtcttaaataattgaaatccttttgccagattgtctaatgtaaatttgttttctggcattgcttcttctatgtcttcttccgtagcaggtactggttcaaaagcactcatctccataaagttgtcttcttttaattcctctagtgtggtgtctcttagctctcgaatttctccaagatacatatcttgaaaccctcccctgactttttgcatatccattatctcttcatgatttctttgattggctctatcataaatcttatgaattcattcacaacatttagacattgtttcttccagcaggcatttattgttttgggcttgatggcttttgcaattttttctgtaagtagcatgacattttcaatggtgtaatccttccagactttcataatgttcaatcatggttatcttccacaacattggcaatcctttctatatagtaccatgtgtaatgagtctgaaaggtccttatgatcccctgatctagagattgaatcagaaatgcatttgagggcaagtagaccatgtagatgcctttggtgctgaactcatgaggctctgggcagccaggggcattgttcaatatcaaaagaactctaaagggcaattatatactggaaaggtattttttgacaatagggacaaatcatcaatagaatcaatttaaaaaaagagttcttgttgtaaaacagaccttcctgttttacaagcaaaagactggcagctggtgtttatcttttaccatcaaggctcaggagttagcagctttatagataagtgcagtcctggtcataaatctgactacatttgcacgaaacagtggagttagcctatcccttcctatgttaaatcttggtgctcatttctctctcttttttttaaatttatttttttattatactttaagttttagggtacatgtgcatattgtgcaggttagttacatatgtatacatgtgccatgctggtgcgctgcacccactaactcgtcatctagcattaggtatgtctcccaatgctatccctcccgcctccccccaccccacaacagtccccagagtgtgatattccccttcctgtgtccatatgatcttattgttcacttcccgcctatgagtgacaatatgcggtgtttggttttttgttcttgcagtagtttactgagaatgatgatttccaatttcatccatgtccctacaaaggacatgaactcatcattttttatggctgcatagtattccacggtgtatatgtcccacattttcttaatccagtctatcattgttggacatttgggttggttccaagtctttgctgttgtgaataatgccgcaataaacatacatgtgcatgtgtctttatagcagcatgatttataatcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacatcctctccagcacctgttgtttcctgacttttgaaagattgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatagggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcattatttctgagggctctgttctgttccattgatctatatctctgttttggtaccagtaccatgctgttttggttactgtagccttgcagtatagtttgaagtcagggagtgtgatgcatccagctttgttcttttggcttaggattgacttggccatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcctggagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattatgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtctattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctgggttagtcttgggagagtgtatgtgtcgaggaatttatccatttcttgtagattttctagtttatttgcgtagaggtgtttgtagtattctctgatggtagtttgtatttctgtgggatcggtggtgatatcccctttatcattttttactgcatccatttgattcttctctctttttttctttattagtcttgctagcggtctatcaattttgttgatcctttcaaaaaaccagctcctggattcattaattttttgaagggttttttgtgtctctatttccttcagttctgctctgagtttagttatttcttgccttctgctagcttttgaatgtgtttgctcttgcttttctagttcttttaattgtgatgttagggtgtcaattttggatctttcctgctttcttttgtgggcatttagtgctataaatttccctttacacactgctttgaatgcatcccagagattctggtatgttgtgtctttgttttcgttggtttcaaagaacatccttatttgtgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcatgtttggaataggtgtggtgtggtgctgaaaaaaatgtatattgtgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtatgggagtctaagtctctttgtaggtcgctcaggacttgctttatgaatctgggtgctcctgtattgggtgcatatatatttaggatagttagctcttcttgttgaattgatccctttaccatcatgtaatggccttcactgtctcttttgatctttgttggtttaaagtctgttttatcagagactaggattgcaacccctgcctttttttgttttccattggcttggtagatcttcctccatccttttattttgagcctatatgtgtctctgcacgtgagatgggtttcctgaatacagcacactgatgggtcttgactctttatccaatttgccagtctgtgtcttttaattggagcatttagtccagttacatttaaagataatattgttttgtgtgaatttgatcttatcattatgatgttagctggttattttgctcgttagttgatgcagtttcttcctagtcttgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgcaattctgggttgaaaattcttttctttatgaatgttgaatattggcccccactctcttctggcttgcagggtttctgccgagagatccgctgttagtctgatgggcttccctttgagggtaacccgacctttctctctggctgcccttaacattttttccttcatttcaactttggtgaatctgacaattattgtcttggagttgctcttctcgaggagtatctttgtgttgttctctgtatttcctgaatctgaacattggcttgccttgctagattggggaagttctcctggataatctcctgcagagtgttttccaacttggttccattctccccatcactttcaggtacaccaatcagacgtagatttggtcttttcacatagtcccatatttcttggaggctttgctcatttctttttattctttttcctctaaaccccttctcgcttcatttcattcatttcatcttccattgctgatacccttttttccagttgatcgcatcggctcctgaggcttctgcattcttcacgtagttctcgagccttggttttcagctccatcacctcctttaagcacttctctgtattggttattctagtaatacattcttctaaatttttttcaaagttttcaacttctttgcctttggtttcaatgtcctcccgtagctcagagtaatttgattgtctgaagtcttcttctctcagcttgtcaaagtcattctccatccagctttgttccgttgctggtgaggaactgcgttcctttggaggaggagaggtgctctgcttttcagagtttccagtttttctgttctgttttttccccgtctttgtggtttttatctacttttggtctttgatgatggtgatgtacagatgggtttgtggtgtggatgtcctttctgtttgttagttttccttctaacagagaggaccctcagctgcaggtctgttggaataccctgccgtgtgaggtgtcagtgtgcccgtgcttgggggtgcctcccagttaggctgttctggggtcagggacccacttgaggaggcagtctgcccattctcagatctccagctgcatgctgggagaaccacagctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgttcaatggcgggcacccctcccccagcctggctgccgccttgcagtttgatctcagactgctgtgctagcaatcagcgagactccgtgggcgtaggaccctccgagccaggtgtggcatataatcttgtggtgggccccttttttaagcccgtctgaaaagcgcagtattcgggtgggagtgacccgattttccaggtgcggtgcatcacccctttctttgactcagaaagggaactccgtgaccccttgcgcttcccaagtgaggcaatgcctcgccctgcttcggctcgcgcatggtgcgcgcacccactgacctgcgcccactgtctggcactcccaatgagattaacccggtacctcagatggaaatgcagaaatcacccgtcctctgcgtcgctcacgctgggagctatagaccggagctgttcctattctcatttctcttattgataaatttcctttgtggcatttctattttttttcctgaagaggacacttttttatctgcattaaaaatctattcaggtaaatattttttctcctcaatggttttcacaaattgtatctgaaaactcatctgctgcctcttgatcatcagaagctgcttctgctgttatattatcttgacatttttttaaagccaaacctctttctaaaattgtcaaaccatcctttgctgacattaaatactcaggctttagatctttcaccttccttttgctttaagttgtcatagaatgacttcattttttcctcaaattatattagagtccatatgtatgcctttcttatagctatcttgcacccgcataaaagctccactttaaataaaagataaaatggtattttgcaacacatgtaagatttacgggcctgctgatgttgctgcagcgatggcttcacaaatttcctttcctttttttacagtggtccttacactggattcatttatcttgaaatgtcaggcaactacagctacagatctaaatctacagtacatatcaagcaattcagctttttcttgtaattttatgacttttctttgcttgggagaagttccagtataactagtggtgctttctttggggtcccatgatgttatttaaggtttacgatattgcactaaacatgttttaagcaaatattcacaacacttgagctcactgcaatagcaacaggaggtgactatgaattattacagcagtacagtaataaattgctgttggtaattttaagcagttatgatttaatactgcatctttacatttgtttacattttttaaactgcaaatgatgccctgcacgggtctgtgcttttttgcttacattttgatacctgttaactttttctgatttttttctatattttacagtttgcattttcaaatcgtcacaaatctccaatttttcaacatatttattgaagaaatccacatataagtggatccacacagttaaacctgtgttgtttaagggtcaactgtttaacacctacaagta

SEQ ID NO: 46 - DNA, 13537 bp, Homo sapiens
acctggtataacatatttccagaattcttaaattccgttaatgataaatacatcttcaattgagataattatagctgtttgagaaaaaaatatatagcggatctttgaacaatgtgcggatgaaagacaccacagtcaaaatccatatatatcttttgactacccgaaaacttagctactaatagcctacttttgactggaggttttagcaagaacatagtcaatatatattttgtatattatatgcattatatgctgtattcttacaataaagtaagctaaagaaaagggaactttttttttttttatttttagtttttagatggagtcttgctctgtggccaggctggagtgcagtggtgcaatcttggctcactgcaacttccaacttctgactccccggttcaagcaattctcctgcctcaacctccctagtagctgggattacaggcacgtgccaccactcccagataatttttgtatttttagtagagaaggggtttcaccatgttggccagtgtggtctcaatctcctgacctcgtgatctgcctgccttggcctcacaaagtgctgggattacaggcatgagccaccgtgcccagccaataaaagagaacattattaagaaaatttaaaaaagacaaaatatatttagtattcattaagtgaaaatggattatgataaagagcttcatccttattatcttcacattgagtaggctaaggaggaggaacatgaggaagggttggtcttgctgtctcaggggtgacagaggcagaaaaggtagaggaggtggaaggagaggcaggagagtcaggcacattccgtgtaactttatggaaacacatcataatttctgtctgacatttttgctttctaatttctctaaaaacatttctatagagtaccaatatttttgccactgtttgcgtaagtttcagtacttgtatcataggagtgttcacgtagtaaacaaagtcaaagttagtcttaaataattgaaatccttttgccagattgtctaatgtaaatttgttttctggcattgcttcttctatgtcttcttccgtagcaggtactggttcaaaagcactcatctccataaagttgtcttcttttaattcctctagtgtggtgtctcttagctctcgaatttctccaagatacatatcttgaaaccctcccctgactttttgcatatccattatctcttcatgatttctttgattggctctatcataaatcttatgaattcattcacaacatttagacattgtttcttccagcaggcatttattgttttgggcttgatggcttttgcaattttttctgtaagtagcatgacattttcaatggtgtaatccttccagactttcataatgttcaatcatggttatcttccacaacattggcaatcctttctatatagtaccatgtgtaatgagtctgaaaggtccttatgatcccctgatctagagattgaatcagaaatgcatttgagggcaagtagaccatgtagatgcctttggtgctgaactcatgaggctctgggcagccaggggcattgttcaatatcaaaagaactctaaagggcaattatatactggaaaggtattttttgacaatagggacaaatcatcaatagaatcaatttaaaaaaagagttcttgttgtaaaacagaccttcctgttttacaagcaaaagactggcagctggtgtttatcttttaccatcaaggctcaggagttagcagctttatagataagtgcagtcctggtcataaatctgactacatttgcacgaaacagtggagttagcctatcccttcctatgttaaatcttggtgctcatttctctctcttttttttaaatttatttttttattatactttaagttttagggtacatgtgcatattgtgcaggttagttacatatgtatacatgtgccatgctggtgcgctgcacccactaactcgtcatctagcattaggtatgtctcccaatgctatccctcccgcctccccccaccccacaacagtccccagagtgtgatattccccttcctgtgtccatatgatcttattgttcacttcccgcctatgagtgacaatatgcggtgtttggttttttgttcttgcagtagtttactgagaatgatgatttccaatttcatccatgtccctacaaaggacatgaactcatcattttttatggctgcatagtattccacggtgtatatgtcccacattttcttaatccagtctatcattgttggacatttgggttggttccaagtctttgctgttgtgaataatgccgcaataaacatacatgtgcatgtgtctttatagcagcatgatttataatcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacatcctctccagcacctgttgtttcctgacttttgaaagattgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatagggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcattatttctgagggctctgttctgttccattgatctatatctctgttttggtaccagtaccatgctgttttggttactgtagccttgcagtatagtttgaagtcagggagtgtgatgcatccagctttgttcttttggcttaggattgacttggccatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcctggagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattatgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtctattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctgggttagtcttgggagagtgtatgtgtcgaggaatttatccatttcttgtagattttctagtttatttgcgtagaggtgtttgtagtattctctgatggtagtttgtatttctgtgggatcggtggtgatatcccctttatcattttttactgcatccatttgattcttctctctttttttctttattagtcttgctagcggtctatcaattttgttgatcctttcaaaaaaccagctcctggattcattaattttttgaagggttttttgtgtctctatttccttcagttctgctctgagtttagttatttcttgccttctgctagcttttgaatgtgtttgctcttgcttttctagttcttttaattgtgatgttagggtgtcaattttggatctttcctgctttcttttgtgggcatttagtgctataaatttccctttacacactgctttgaatgcatcccagagattctggtatgttgtgtctttgttttcgttggtttcaaagaacatccttatttgtgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcatgtttggaataggtgtggtgtggtgctgaaaaaaatgtatattgtgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtatgggagtctaagtctctttgtaggtcgctcaggacttgctttatgaatctgggtgctcctgtattgggtgcatatatatttaggatagttagctcttcttgttgaattgatccctttaccatcatgtaatggccttcactgtctcttttgatctttgttggtttaaagtctgttttatcagagactaggattgcaacccctgcctttttttgttttccattggcttggtagatcttcctccatccttttattttgagcctatatgtgtctctgcacgtgagatgggtttcctgaatacagcacactgatgggtcttgactctttatccaatttgccagtctgtgtcttttaattggagcatttagtccagttacatttaaagataatattgttttgtgtgaatttgatcttatcattatgatgttagctggttattttgctcgttagttgatgcagtttcttcctagtcttgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgcaattctgggttgaaaattcttttctttatgaatgttgaatattggcccccactctcttctggcttgcagggtttctgccgagagatccgctgttagtctgatgggcttccctttgagggtaacccgacctttctctctggctgcccttaacattttttccttcatttcaactttggtgaatctgacaattattgtcttggagttgctcttctcgaggagtatctttgtgttgttctctgtatttcctgaatctgaacattggcttgccttgctagattggggaagttctcctggataatctcctgcagagtgttttccaacttggttccattctccccatcactttcaggtacaccaatcagacgtagatttggtcttttcacatagtcccatatttcttggaggctttgctcatttctttttattctttttcctctaaaccccttctcgcttcatttcattcatttcatcttccattgctgatacccttttttccagttgatcgcatcggctcctgaggcttctgcattcttcacgtagttctcgagccttggttttcagctccatcacctcctttaagcacttctctgtattggttattctagtaatacattcttctaaatttttttcaaagttttcaacttctttgcctttggtttcaatgtcctcccgtagctcagagtaatttgattgtctgaagtcttcttctctcagcttgtcaaagtcattctccatccagctttgttccgttgctggtgaggaactgcgttcctttggaggaggagaggtgctctgcttttcagagtttccagtttttctgttctgttttttccccgtctttgtggtttttatctacttttggtctttgatgatggtgatgtacagatgggtttgtggtgtggatgtcctttctgtttgttagttttccttctaacagagaggaccctcagctgcaggtctgttggaataccctgccgtgtgaggtgtcagtgtgcccgtgcttgggggtgcctcccagttaggctgttctggggtcagggacccacttgaggaggcagtctgcccattctcagatctccagctgcatgctgggagaaccacagctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgttcaatggcgggcacccctcccccagcctggctgccgccttgcagtttgatctcagactgctgtgctagcaatcagcgagactccgtgggcgtaggaccctccgagccaggtgtggcatataatcttgtggtgggccccttttttaagcccgtctgaaaagcgcagtattcgggtgggagtgacccgattttccaggtgcggtgcatcacccctttctttgactcagaaagggaactccgtgaccccttgcgcttcccaagtgaggcaatgcctcgccctgcttcggctcgcgcatggtgcgcgcacccactgacctgcgcccactgtctggcactcccaatgagattaacccggtacctcagatggaaatgcagaaatcacccgtcctctgcgtcgctcacgctgggagctatagaccggagctgttcctattctcatttctcttattgataaatttcctttgtggcatttctattttttttcctgaagaggacacttttttatctgcattaaaaatctattcaggtaaatattttttctcctcaatggttttcacaaattgtatctgaaaactcatctgctgcctcttgatcatcagaagctgcttctgctgttatattatcttgacatttttttaaagccaaacctctttctaaaattgtcaaaccatcctttgctgacattaaatactcaggctttagatctttcaccttccttttgctttaagttgtcatagaatgacttcattttttcctcaaattatattagagtccatatgtatgcctttcttatagctatcttgcacccgcataaaagctccactttaaataaaagataaaatggtattttgcaacacatgtaagatttacgggcctgctgatgttgctgcagcgatggcttcacaaatttcctttcctttttttacagtggtccttacactggattcatttatcttgaaatgtcaggcaactacagctacagatctaaatctacagtacatatcaagcaattcagctttttcttgtaattttatgacttttctttgcttgggagaagttccagtataactagtggtgctttctttggggtcccatgatgttatttaaggtttacgatattgcactaaacatgttttaagcaaatattcacaacacttgagctcactgcaatagcaacaggaggtgactatgaattattacagcagtacagtaataaattgctgttggtaattttaagcagttatgatttaatactgcatctttacatttgtttacattttttaaactgcaaatgatgccctgcacgggtctgtgcttttttgcttacattttgatacctgttaactttttctgatttttttctatattttacagtttgcattttcaaatcgtcacaaatctccaatttttcaacatatttattgaagaaatccacatataagtggatccacacagttaaacctgtgttgtttaagggtcaactgtttaacacctacaagtacattacattgattttaaattagttacgtattttagaaaatttaaatcgctattggggaagtaatttaaattatagagtgttctttagaattaatcaaataccatataacaaattgttgaagcttttattcaaagattgtagatttcttaaaaattccttttaatctttattcttgttcagccatatatatatatataaagctgaacacacacaccttagagatacacatgcttaggtgcaggaagttgcagtacaagaatattcagacaagcattagttacaaaattatcagagttaattaatattgggaagaattcatattccaccaacattgaatgaataaatatatcacattattttcctcactaccatgactcctaccccatagtaagcagtaagctaaatgttgtgttttcatcaggttacgttggtgatatctgggaatccacctttccatacatgaaaacaatgccaattttaaattaaaggcaaataatggttggaaaagtcatttgtgttttatttagtatatttttaaaaactttttttaatggtaaaatatacataacataaaatgtaccattttaatcgtgtttaagtgttcagttttgtggtgtgaaatacatttacattgttgtgccacatcatgaccatctacctccagaactcttcatctcaaactgaaactctgtacctattaaggcgtaactccccgtattctccctccctggcccatggcaaacgcctatttagtgtaaattttgaattaacatgctaatgtgaaaagtttctctgaaactaaacaaggaaattaattgatttaatcctgaattaaaactaattccgggtaaaactcaggttactgaatttatgaatttcacaataccatttggcatccctatttcccgtacaaaccttttgctccacttggatatttcttgcaagtactttgcttatctgagatcagacaagtaaaaaagaaattcagcagtgccgtatattttaattgcaatgttaattctgcacatttcagagtaagatgggagaagaatgtgtatgatttgacagtataaaatactcataataaaactgcttggtaatatccagatgattcattagtaaaaatgtagaactggagggttaagaaaatgtttgaatgttaaacagagttgctacttgaattttctatgttttattgtgaaagtgagaaaacataaataattatttttggaaaattatttttaaatgttgtattttgagctaaaacaatccccaaattcatgatatattaatatttatctgttttaatgttcagtggtggctgtaattgtattacacacacaaaaaggaagcataggtaccactagattaatgtttttgagaaagaatccaatttcttttattaaatacattattcagataaataaatcatagtacattaagcgatgctttataatcctatgcatactttgaaaaatattatggaaaagcatgcttaatatcatgagaaaatgttcatatatatagtcaaatgggtgcaagattgctataagaaaggcatacatatggactctaattactatgctaccattaaaataatttgaacacacacaagtacatgtctacatatacatagatatattatacatagatatatgaatgctgtgtttttctcactgggtgataagattaagctgatacttagatttctcttttgtttcccacataaagtaaataaatgcaatattttcaaactaaagtatcctatgtaatttcacttaagttgtatttactatggggcaccactgattttgaaatgatcaatgtaatgttctctttatttcatgcatgaatagcttcctaagttcttattaatatcatttttacacatctgaacacctttataaaataccgtaactgtgctggccagtaatgttgtcaagattgaattctttttgtatggttttttatttatttgttttcacaaaaatgaaatactaaatataccttaaaggaaactaactgttcagcccagcatgtagtgaatgctttgatcatagaagcagttattttacacaaaattaattcagttcgaatagagattcacaataaactgagtggcagattgcacttcagaatgtatcacaccaatttaggactttcattttatccaaatttcatatggaaaactttctatagttgtcactcttataatatgactgtatgaacattgaatctagtctgcaataaactattaagatgtgagtcctccaaagatatcttgctacaccgatcttgaagaaggaagtacaaacaattaatttaaaatgctgctattgtgtttgtattggcatttgcaattgaatagtctgcataaaatttaggaatgaagactttaataactgatttgcagtacttgtattgagaaaataattttctcaaatgtgggactacagttctgctcctcaagtaaaagcccatgaaacaagatctgataaaattaataataagaaggattaagcaaaatagagcatcaacttataacagtgtactttataatcttatacatgtatttattaaactagctcaggagcacttccagtaaaggcacatttaatgagagtgaattttagttgagatagaaaagcagatcatatgggtacgtcagtctctaatcaactttttagtggtaatccaggaaggatcttcaatttaacttggaaggtgtttctagtgtttagattttctcctagtaatttaacctgaacatatgtttgtaatagctttcttcataaaaggccataagtagggtaagtagctagatagtatatgttaagatattaaaataagacttttttcacccttctcatatttgtataattaatatgttgccaatatttagtggaaaataaaattgattttgatgtatgagaagcttaacaatccatatttaaacttatagcatggctttaagccatcatgttcttggctttatttataaagatgggtattttaaaagacaaggatcagccagacctgcagagttgcccaaggaagaaaatgccttgtgtgtaggccgaccacaaacaaaatgagccatgggtagaaatatctgcagcaaaaggtaatcaattgcacttgacggacttctgaacaatatgcaatttaactcaatgatacctagctgctcctatctttttaatagcttgtgaattcagaagacataagttacatgagtatcttggcaaactacattttcacattttcaaccctcacctcaacttcagcttcatctgggaactttgccataattgataggaaaagaagtacaaattcttttccattcatagagcaatttataaagaaagtctctagcctatcttcccaaatgaaccatgaacgattaaaaataaggcacacttacagcaatattttccaattgatcaatttaagtttgaaaatggcggagattgtattggttaagaatatttataacagatagaacaaagcaaaaaataaaaataaaaaacccacaaatgatgaataggcaaattggtcccccaagactcctaacatttttttaacagtatttttatcttttcagttcttatatagcaattctttcattgtcatagaactctaaaaaaacagtagttataattgaattaataagaattatgaatataatatatgccatgaagctctttgaaggagttgtctgattcaattttctgctaccttttacctacattaacaaacagaggaagaaaaccaaaacaaagctaagagcagagaggtaatttggttttaaaaatatctgtgggaggtacagatgcattcagacaacttcctccacttctttgattcctgctttctaagtggttccctttcaatttgtttatattgtgtcaacaagttagaagattgcagaaaaaaaaaatgcatcattttcttggttgacaaaccaaaaatagttcatttaaagaatacagaaggaactggaatttcatattgctttccttgctgtttcttttctttgtgctaataatagcatcaaaaataaagcccccaagtcagcaagtttttgacactctgattggctgaacacaatgaaaagctgtttgttaggcacaaaatttacctacattttttttttcaatttccagcaatggtcaggtgacttgtggaacatgagggatatctaagggaagtacataaggatgccctaaggaaaattcccactttgttattaatatctggagaaagacaatacatgtggcaagggaaatgaaaggactgtgttcatgtcataaaggaaagagtaatctgttagaaaatacatctctaatggaaaaaagagaaaggatgtggaaaataaaaatgatctgggaaacatgttgattgtgtgggaaaagattactccagaaataatttagaatgcacaattggcataaggagatttggatttgcattataaatatatagcctgctattactggcaacttcctggtcataattattttcatctcttttctttttattgatatatagagcctgctctgcataatctcatacattgtgttctgatactttata

SEQ ID NO: 47 - DNA, 1749 bp, Homo sapiens
agtaaagggataaagtagaaggcagtatctaaaacagcaaagacttactcctattggaaaattttcatgaaatatgtgcaaacaacatgcaaaataaggtaacttaagcatgtggcattggctacggaatttaaagaagtgtgtgatgcagctcttcctctaacttgataggctgtggggtgtgattataatggtgagtagcaaagagtgggtgtgagtggcccacatgtcagcagagaagactattgtgtcatttacattatttaaaattccagtgcattatgatttaaaaactccaacccttatttggttttattattattttaaaatctctacaagtatgctggtcattattagtggtattactaccaataccattgccttcatagccactggtttactctgtattaaaaatggaaacttggccaaacaaaaaaaaaagctacctgttaaaaagggcctaagggcaaaacgactttaccaaacttagggaagaatggaaaccaactcaaggtctcccagtaggactgcctacaccacatctttctctccatcatcctaattaccaaacagtacagaacttatcacattctaccatatttgaaaaaaaaaattattccacattaaaaacaattttatagaacagctatctcgtggaaaaaatgtttcaagtgtatcagctagttataacaatgctacgagagagataacagtatatgtatttgcacagaaaacataaaacataaacagtggaattacatgcattttttattttttgttttatgattttctattttttaactttataaaaataagcattataattattactaaaaagacacaaacatcaaaatatttaaagtttttctatataaaggaacattatagcaatgtggacttgtaccatctctttattatttctcttctcagaagttatttgaaaaaacagaaactgtgagaccttattatccagctgcatgtggtatcttcaactcaaatactcaatttagcaaacacatgcatgtgtgtgcacacacacatattattttcaatatcacagtcattcaacaataatttcctgaagattaagatggtataaaaattaaagggactctagaatcacgacgttaagttttgaaccttattgtcatttgttatgtaacactatacattttgttttccctaaataaaaactgtaagcctttttatatagttgcttaaatatctggacttaaatcataccattcttataaaatttaaaatgagaaatatatttaaagagctttgtggaatttttggcacattttaaaaaataaatgctcaccatttttgttaaataatgactatgtataatacactgtgctaccaatgtgtggatattaaagtaatactacaagataatttattttttcaatataattttgtaattaatacttgtgaaagattagagaatgtaaagttttatttttaatttttctatcagcacttataatgtaaatatattaactcattatctactttcatttttatttattacaacgacaggttaaatcatttccccttattggatagcataatatacaggctttcctaactatctaacgttgtaaaaagtgctgtttatcatgtttatctggtgtcacatgtaaataaatatctaatataattggaaatcttcgggcagtgagaggagatgctgtcaaaacatgaatgatttgtccatatcatcgttttctgagtcttataatt

SEQ ID NO: 48 - DNA, 7339 bp, Homo sapiens
tcagccttaagggatttctagaaaaaaaaaaagggttagtaattgtgtggtcttctccattacaaagatgctgatatttcaaattcaaagggttacaataaatgagagcttgggagagtgtatgcaaacctgttagtagaaaggtagagcattgcttatgcccttggtcttgtcagttgtatctacaacacgtaagtagtaaaggggttgctaagcaacttctaacttttaacattaagtgtgctcagggactgcatactgcaaaggcacagtattgcccattggtagaagaggatgccctaagtaagatgaagtggaaggtatctctttattgtcctttcagtttgttgtttgtggaacaggaagcaaaagagagattcatgttttggtttgttctggaaacttatagaactcaagagtagtagaatgactaaaattatttttgtcattcctacatcttgtttttcttcataactattatttagattctgctctctcatcaggaagattcctttttttcttcttttcctgaaatcaatccctgagcctccatggtggctgtggagggacctttcacatagcaacaccttgattcttgtacactgggaatctccttgcccttggaaaggcactgtgactccttagtattttatttcaaaagaagctaccttatacctcaggggagaacgatttgagacatttaaacaccagcaacaacagaacctgacacacaaataaaatattcttcctaagcccaaaggatacaaaaatgtgttcagtatatttaagctaactaactaaagttatcctgccttgttttctgaagctttaggctcaacccattgaagtgctgacttttagggctgtagtagctgtcatctcagcagctgctgcagagaaacctgtaccagccctccttaaaatctacactcaaaaaagtaaggcccaaagagagaagacacttactctccagtgtgccccaggcttaccttgtgaattctgattattgttttaggattacacttttttcttgaataactgacaggggatctgaaatgatgaatatattacatggagatcctgggtcccaattcccaggaaagtgatctacctgctacctcaacaagccaaccatatcagaatgcaatacaacattcctaaggcaagtatgtgcatgtgctaggagtttagtggattaaacattccttttctctgcatgagaatttctcattaatacttctttatggatagaaggcaagaacagaatcaataaacagcgcaaaatcaaggcaccaccctagagttctgtctttcctttatccttatagccacttttctatatctacattcactacaaaatcagcccctcgatatccaatacaggccatgtaaggtattccaaaaattaaaactcaattgcgagagacactgaaggacaaagaattttccacagtgcttcctgagcctttctcccatgcccttgtatataatctcaactcctaactgctttagttcaacactgttgacaaaagtcttattgcctaaacaataacggatctgcacaatccctttcttttcgagaaatatctatgacaaacatcaacttcagctcacccctcctgttaaacctccttaaaacactctgccctcctgctccaagtatgaatgttcatttggagccttctcatgcctggcattttcaataaaagcttatgttaatagggcttgattgattttcttccacacaatttataaaatacacgcttaacattttactctcttagaatcaacatcatgatgactttgcaaatcttcaatgtcacactctgtattattctcaaataatattgtgagtcccctgttttcaaatgtatacttggcctcttttcaaacatatatgttagcttccttttaaaatagccttttagagttcatttgctagccagtaccagatgctctaaaattggggactgcaaagtaatttcagaaggagtgaaatttggtgtcctacccagatttctaaaagagaagctggaaaaatcatgtgttaatgagagtcatgtggtagatgcccaattcttggctagaggaagtcattttttcctgtatgcagatccccagcaaatactacaatacattttcaaataaatagtatatgggtctgtttccccataaccaccattgctgactacctaatctgacaccattgttaactggaaatacaactatttccttctaattgctatccctatgtccttattagcctcaaacaatctattcttttcatagaagccagagcattctttcaaaaatgtaagcagaatgtgccactcttctgcttaaactcccaagactttactccacagtgccgtttttgatttctgaaaacaccttgttctctccttgcccttgttgcttccttggtgtccttgctctcacctcctcccaagattgtctttttctcatcatttaggtctctgcttaaaaagtctctttttaagagatgcttcttagaacacagaatctaagctctacctctcccatcaatactcttcatcacattgtcctgttctatttattgagcttacgttttggagtacttaataatattttaatttattctattcatttttacttgtttgctagttttctggaccacaccaatcatttatgctacacagagcaaggaacttatttgtcttgtcaacagtggtaacttcagttatgtagaatagacttgacatatagccatatagtgggtactcagtataatttctgtttatttttaatttttttatgtgtagtttttactttgcgataagaatatatggaatttctcttctctgaaactcccttattctgtaacttcagctttttatgttcttatttgttattttcttcctgttgatagaattttgtccacgtttgtgtttcttataatttaagctttttttataattatagattctattttacttttatttgcttattttcattattattataataaatattaactacttatgtagagcttataatatactaggaagttgatatgtattggctctgcacccccaccgaaatctcaccttgaattgtaataatccccacgtgttgtaggagggacctggtgggaggtaactgaatcatgcagatgggttttttctcatgcctttcttgtgatagtgagtaagtctcaagagatctgatggttttgtaaagggaagtttccctgtatatcacctttgcctgccgccatgtaagatgtgactttgatcctcatttgccttctaccatgattgtgaggcctttcttgccatgtagaattatgagttaattaaacctcttccctttataaattacccagtctcaggtatgtctttattagtagtgtgagaacagactactacagtaaattggtactgggtagtgggacactgctgtaaagacacctgaaaatgtggaagcaactttggaactgggcaacaggcagaggttgcaacagattggagggctcagaagacagaaacatgtggaaaagtttggaacttcttagagacttgttgaatggttttgaccaaaaagctaatagtgttatgaacaataaaatccaggctgaggtggtctcatagggacatgaaaaacttgttgggagctggaacaaaggtcactcttcctatgcaaagaaactggtagcgttttgccactgtcctaaagatctgtggaactttgaacttgagagaaataatttagggtatccattggaagaaatttctaagtagcaaagtgttcaagaggaagtagagcataaaagtttgaaaaatttgcagcctgaaatgcagtagaaaagaaaaccccattttctggggagaaattcaagccttcagcagacatttgcataagcaacaaggagccaaatgttaattgccaaggtgacagtccccaacccccatcataagctcagacgcctaggagggaaaaatggtttcctgggctgggtccagggacccctgctgtgtgcagcctacgtacttggtcccctgcatcccaactgctctagtcatggctaaaagagaccaaagtgtatcttgggacatggcttgagagggtgcaagctccaagcctcagcagcttccacatggtgctgagcttgtgggtacacagaagtcaagaattgaggtttgtgaacctttgcctagatttcagagcatgtatgaaaacacctggatgttcaggcagaagtgtgctacagtggtggtgccctcatggagaacctctgctagagcagtgcagaggagaaatgtagggtcggagcccccacacagagtccccaatggggcactgtctattggatctgtgagaatggggccaccgtcctccagaccctagaatggtagatccactgacaacttttgtcatgcacctggaaaagccacagacactcactgccagcacatgaaagcagccaggagggtggccgaatcctgcaactgcacaggagcgaagctgcccaaggtcgtgaaaatccacatcttgcatcagcatgacctagatgtgaaacatggagtcaaagattatttccaagttttaagatttgactgccccgctggatttctgacttgcatggggcctgtaaccctttgttttggccaacttatctcatttggaatgggtatatttaccaatgcctgtaccccagttgtatctaaaaagtaattaacttgtatttgattttacaggctcctagatggaagggacttgcctcgtctgcaatgagattttggacttggacttttgggttaatgctggagttagttaagactttgggggactgttggaaggcatgattgtttttgttttgttttgtttctttgagacagagtctcactctgtcactcaggctggagtacagtggcatgatctcagctcactgcaacctctgctgccctggttcaagggattcgcctgcctcagcctcctgagtagctgggattatacatgcctgccaccacacccagctaacttttgtaattttagtagagacagggtttcaccatcttggtcaggctggtcttgaactcttgaccttgtaatccacctgccttggcctcccaaagtgctgggattacaggcgtgagccaccgtgcctggctgattgtgttttaatatgtgaggacatgaaatttaggaggggccaggggtgcaatgatacggtttggctccatttccccactcaaatctcaccttgaattgtaataatccccacatgtcatggaagggacccagtgggaggtaattgaatcatgggagcagatttttcttgtgcttttgtcatgataatgaatctgtctcataagagctgatggttttataaagggagttcccctgcacatgccctcttgcctgataccatgtaagacatgactttgctgctcattcaccttccgcagtgattgcgaggcctctccagccatgtggaactgtgagtcaaacctctttcctttataaattactcactctcaggtatgtgtttattagcagtgtgagaacagactaatacagaagtattctaaacacttcacaaatattagcttatttattaacatcctcttgtgttagtgcatagatactattattgtccttattttacatacagagaaactgaggcacaaagaggatagttaaggttcataatcacatagcaaatagaagagtcaggatttaaactcaaatctgggtaatctggaatccagaatacaaactcttaaatgaatacataaatcgaaaccccaaaatgatatatatttaaaatattttctcacatatgattcaatattttccttttcaaccatgctcttctgagaatttttatgttttaaacaaaggacattcgtttcttaaggggtaaaaatatggcttagaataaaatggaccttagaatgggctaggatccattctttaatctggaccctaacactttgggaatctaaggaattacaataatttcgaacctaagcctttaagaaataagatgttttctaaattctcaagctcatttttactaaatcacatactaaagagatgttccctgtgctatggtggaaattggttgagaaatatgacctaggaatattatcattccaaaagtaaagcttccagaaaattttattttggtagatgaggattagaggaacaagaagaaaatcataacattagggccaatgccaattgcaaagtcctgtattcaatgcagcattctgaggtatagaggggtaagagctaaggaagatgtataagttgttgagctggagagtagcccccagaacctgcagacatcatcatgatgcacaaaaacaagcggagagattctagacttctggggatcatggaatatttgaagaaaaccgggagactagaagggtctggaatcacaatagagggattgcgactggacattttggtgcttgtctatggcaggtgggaacaagctgctcacaagaaacaggcaagaccagctaagcttcagtggaaatcaaagttgaacaccaagagtagaggtcagagcagaccttaatcctgtggagactcgttaagtccagaggacagcagttgtaccaaatgtgtctctagccaatcacattgacacaaacatcctttggcatccaggttcaaggaggacaaaagatgagctttatagaaagaggaatacctaataggatgggaatgttggctttgttttttgtttttgttctttattgtatgaacagtttgagttaaaaaaaaagattaaattttaacttgggcaagctgacaataatagaaactcaagagaatttgaaattttcctgtaataaataaagaggaatatatatatatacacacacacacacacgcatatatatatatgcacacacaagatgaagtgtgggcacatttgcaattctgttatctaagagaagaaagactaagaagcacagaggattgtgagtaaaaagaggaagcaatcatcaaggcttccttttatattatattgaaggaaatgctgagtaactttagacacagtgcaaaatattctagcaatttaaaaagatcaatatgaagatagagtcatgcatgtaaaatttgctgagatatattggctatatgaccaaatttcattcccatgtgaaagaatatatttggaaagcaatgaaagtctatacacagaaatagccatttccattcactggaggaccaaggaaaaattaattacaaggtctgagaaagtgttaatctgccatagtgcttttgctgtctataaaaatggcaacataggtttgttactaacttgtacatttgg

SEQ ID NO: 49 - DNA, 2811 bp, Homo sapiens
tcagccttaagggatttctagaaaaaaaaaaagggttagtaattgtgtggtcttctccattacaaagatgctgatatttcaaattcaaagggttacaataaatgagagcttgggagagtgtatgcaaacctgttagtagaaaggtagagcattgcttatgcccttggtcttgtcagttgtatctacaacacgtaagtagtaaaggggttgctaagcaacttctaacttttaacattaagtgtgctcagggactgcatactgcaaaggcacagtattgcccattggtagaagaggatgccctaagtaagatgaagtggaaggtatctctttattgtcctttcagtttgttgtttgtggaacaggaagcaaaagagagattcatgttttggtttgttctggaaacttatagaactcaagagtagtagaatgactaaaattatttttgtcattcctacatcttgtttttcttcataactattatttagattctgctctctcatcaggaagattcctttttttcttcttttcctgaaatcaatccctgagcctccatggtggctgtggagggacctttcacatagcaacaccttgattcttgtacactgggaatctccttgcccttggaaaggcactgtgactccttagtattttatttcaaaagaagctaccttatacctcaggggagaacgatttgagacatttaaacaccagcaacaacagaacctgacacacaaataaaatattcttcctaagcccaaaggatacaaaaatgtgttcagtatatttaagctaactaactaaagttatcctgccttgttttctgaagctttaggctcaacccattgaagtgctgacttttagggctgtagtagctgtcatctcagcagctgctgcagagaaacctgtaccagccctccttaaaatctacactcaaaaaagtaaggcccaaagagagaagacacttactctccagtgtgccccaggcttaccttgtgaattctgattattgttttaggattacacttttttcttgaataactgacaggggatctgaaatgatgaatatattacatggagatcctgggtcccaattcccaggaaagtgatctacctgctacctcaacaagccaaccatatcagaatgcaatacaacattcctaaggcaagtatgtgcatgtgctaggagtttagtggattaaacattccttttctctgcatgagaatttctcattaatacttctttatggatagaaggcaagaacagaatcaataaacagcgcaaaatcaaggcaccaccctagagttctgtctttcctttatccttatagccacttttctatatctacattcactacaaaatcagcccctcgatatccaatacaggccatgtaaggtattccaaaaattaaaactcaattgcgagagacactgaaggacaaagaattttccacagtgcttcctgagcctttctcccatgcccttgtatataatctcaactcctaactgctttagttcaacactgttgacaaaagtcttattgcctaaacaataacggatctgcacaatccctttcttttcgagaaatatctatgacaaacatcaacttcagctcacccctcctgttaaacctccttaaaacactctgccctcctgctccaagtatgaatgttcatttggagccttctcatgcctggcattttcaataaaagcttatgttaatagggcttgattgattttcttccacacaatttataaaatacacgcttaacattttactctcttagaatcaacatcatgatgactttgcaaatcttcaatgtcacactctgtattattctcaaataatattgtgagtcccctgttttcaaatgtatacttggcctcttttcaaacatatatgttagcttccttttaaaatagccttttagagttcatttgctagccagtaccagatgctctaaaattggggactgcaaagtaatttcagaaggagtgaaatttggtgtcctacccagatttctaaaagagaagctggaaaaatcatgtgttaatgagagtcatgtggtagatgcccaattcttggctagaggaagtcattttttcctgtatgcagatccccagcaaatactacaatacattttcaaataaatagtatatgggtctgtttccccataaccaccattgctgactacctaatctgacaccattgttaactggaaatacaactatttccttctaattgctatccctatgtccttattagcctcaaacaatctattcttttcatagaagccagagcattctttcaaaaatgtaagcagaatgtgccactcttctgcttaaactcccaagactttactccacagtgccgtttttgatttctgaaaacaccttgttctctccttgcccttgttgcttccttggtgtccttgctctcacctcctcccaagattgtctttttctcatcatttaggtctctgcttaaaaagtctctttttaagagatgcttcttagaacacagaatctaagctctacctctcccatcaatactcttcatcacattgtcctgttctatttattgagcttacgttttggagtacttaataatattttaatttattctattcatttttacttgtttgctagttttctggaccacaccaatcatttatgctacacagagcaaggaacttatttgtcttgtcaacagtggtaacttcagttatgtagaatagacttgacatatagccatatagtgggtactcagtataatttctgtttatttttaatttttttatgtgtagtttttac

SEQ ID NO: 50 - DNA, 20936 bp, Homo sapiens
tcagccttaagggatttctagaaaaaaaaaaagggttagtaattgtgtggtcttctccattacaaagatgctgatatttcaaattcaaagggttacaataaatgagagcttgggagagtgtatgcaaacctgttagtagaaaggtagagcattgcttatgcccttggtcttgtcagttgtatctacaacacgtaagtagtaaaggggttgctaagcaacttctaacttttaacattaagtgtgctcagggactgcatactgcaaaggcacagtattgcccattggtagaagaggatgccctaagtaagatgaagtggaaggtatctctttattgtcctttcagtttgttgtttgtggaacaggaagcaaaagagagattcatgttttggtttgttctggaaacttatagaactcaagagtagtagaatgactaaaattatttttgtcattcctacatcttgtttttcttcataactattatttagattctgctctctcatcaggaagattcctttttttcttcttttcctgaaatcaatccctgagcctccatggtggctgtggagggacctttcacatagcaacaccttgattcttgtacactgggaatctccttgcccttggaaaggcactgtgactccttagtattttatttcaaaagaagctaccttatacctcaggggagaacgatttgagacatttaaacaccagcaacaacagaacctgacacacaaataaaatattcttcctaagcccaaaggatacaaaaatgtgttcagtatatttaagctaactaactaaagttatcctgccttgttttctgaagctttaggctcaacccattgaagtgctgacttttagggctgtagtagctgtcatctcagcagctgctgcagagaaacctgtaccagccctccttaaaatctacactcaaaaaagtaaggcccaaagagagaagacacttactctccagtgtgccccaggcttaccttgtgaattctgattattgttttaggattacacttttttcttgaataactgacaggggatctgaaatgatgaatatattacatggagatcctgggtcccaattcccaggaaagtgatctacctgctacctcaacaagccaaccatatcagaatgcaatacaacattcctaaggcaagtatgtgcatgtgctaggagtttagtggattaaacattccttttctctgcatgagaatttctcattaatacttctttatggatagaaggcaagaacagaatcaataaacagcgcaaaatcaaggcaccaccctagagttctgtctttcctttatccttatagccacttttctatatctacattcactacaaaatcagcccctcgatatccaatacaggccatgtaaggtattccaaaaattaaaactcaattgcgagagacactgaaggacaaagaattttccacagtgcttcctgagcctttctcccatgcccttgtatataatctcaactcctaactgctttagttcaacactgttgacaaaagtcttattgcctaaacaataacggatctgcacaatccctttcttttcgagaaatatctatgacaaacatcaacttcagctcacccctcctgttaaacctccttaaaacactctgccctcctgctccaagtatgaatgttcatttggagccttctcatgcctggcattttcaataaaagcttatgttaatagggcttgattgattttcttccacacaatttataaaatacacgcttaacattttactctcttagaatcaacatcatgatgactttgcaaatcttcaatgtcacactctgtattattctcaaataatattgtgagtcccctgttttcaaatgtatacttggcctcttttcaaacatatatgttagcttccttttaaaatagccttttagagttcatttgctagccagtaccagatgctctaaaattggggactgcaaagtaatttcagaaggagtgaaatttggtgtcctacccagatttctaaaagagaagctggaaaaatcatgtgttaatgagagtcatgtggtagatgcccaattcttggctagaggaagtcattttttcctgtatgcagatccccagcaaatactacaatacattttcaaataaatagtatatgggtctgtttccccataaccaccattgctgactacctaatctgacaccattgttaactggaaatacaactatttccttctaattgctatccctatgtccttattagcctcaaacaatctattcttttcatagaagccagagcattctttcaaaaatgtaagcagaatgtgccactcttctgcttaaactcccaagactttactccacagtgccgtttttgatttctgaaaacaccttgttctctccttgcccttgttgcttccttggtgtccttgctctcacctcctcccaagattgtctttttctcatcatttaggtctctgcttaaaaagtctctttttaagagatgcttcttagaacacagaatctaagctctacctctcccatcaatactcttcatcacattgtcctgttctatttattgagcttacgttttggagtacttaataatattttaatttattctattcatttttacttgtttgctagttttctggaccacaccaatcatttatgctacacagagcaaggaacttatttgtcttgtcaacagtggtaacttcagttatgtagaatagacttgacatatagccatatagtgggtactcagtataatttctgtttatttttaatttttttatgtgtagtttttactttgcgataagaatatatggaatttctcttctctgaaactcccttattctgtaacttcagctttttatgttcttatttgttattttcttcctgttgatagaattttgtccacgtttgtgtttcttataatttaagctttttttataattatagattctattttacttttatttgcttattttcattattattataataaatattaactacttatgtagagcttataatatactaggaagttgatatgtattggctctgcacccccaccgaaatctcaccttgaattgtaataatccccacgtgttgtaggagggacctggtgggaggtaactgaatcatgcagatgggttttttctcatgcctttcttgtgatagtgagtaagtctcaagagatctgatggttttgtaaagggaagtttccctgtatatcacctttgcctgccgccatgtaagatgtgactttgatcctcatttgccttctaccatgattgtgaggcctttcttgccatgtagaattatgagttaattaaacctcttccctttataaattacccagtctcaggtatgtctttattagtagtgtgagaacagactactacagtaaattggtactgggtagtgggacactgctgtaaagacacctgaaaatgtggaagcaactttggaactgggcaacaggcagaggttgcaacagattggagggctcagaagacagaaacatgtggaaaagtttggaacttcttagagacttgttgaatggttttgaccaaaaagctaatagtgttatgaacaataaaatccaggctgaggtggtctcatagggacatgaaaaacttgttgggagctggaacaaaggtcactcttcctatgcaaagaaactggtagcgttttgccactgtcctaaagatctgtggaactttgaacttgagagaaataatttagggtatccattggaagaaatttctaagtagcaaagtgttcaagaggaagtagagcataaaagtttgaaaaatttgcagcctgaaatgcagtagaaaagaaaaccccattttctggggagaaattcaagccttcagcagacatttgcataagcaacaaggagccaaatgttaattgccaaggtgacagtccccaacccccatcataagctcagacgcctaggagggaaaaatggtttcctgggctgggtccagggacccctgctgtgtgcagcctacgtacttggtcccctgcatcccaactgctctagtcatggctaaaagagaccaaagtgtatcttgggacatggcttgagagggtgcaagctccaagcctcagcagcttccacatggtgctgagcttgtgggtacacagaagtcaagaattgaggtttgtgaacctttgcctagatttcagagcatgtatgaaaacacctggatgttcaggcagaagtgtgctacagtggtggtgccctcatggagaacctctgctagagcagtgcagaggagaaatgtagggtcggagcccccacacagagtccccaatggggcactgtctattggatctgtgagaatggggccaccgtcctccagaccctagaatggtagatccactgacaacttttgtcatgcacctggaaaagccacagacactcactgccagcacatgaaagcagccaggagggtggccgaatcctgcaactgcacaggagcgaagctgcccaaggtcgtgaaaatccacatcttgcatcagcatgacctagatgtgaaacatggagtcaaagattatttccaagttttaagatttgactgccccgctggatttctgacttgcatggggcctgtaaccctttgttttggccaacttatctcatttggaatgggtatatttaccaatgcctgtaccccagttgtatctaaaaagtaattaacttgtatttgattttacaggctcctagatggaagggacttgcctcgtctgcaatgagattttggacttggacttttgggttaatgctggagttagttaagactttgggggactgttggaaggcatgattgtttttgttttgttttgtttctttgagacagagtctcactctgtcactcaggctggagtacagtggcatgatctcagctcactgcaacctctgctgccctggttcaagggattcgcctgcctcagcctcctgagtagctgggattatacatgcctgccaccacacccagctaacttttgtaattttagtagagacagggtttcaccatcttggtcaggctggtcttgaactcttgaccttgtaatccacctgccttggcctcccaaagtgctgggattacaggcgtgagccaccgtgcctggctgattgtgttttaatatgtgaggacatgaaatttaggaggggccaggggtgcaatgatacggtttggctccatttccccactcaaatctcaccttgaattgtaataatccccacatgtcatggaagggacccagtgggaggtaattgaatcatgggagcagatttttcttgtgcttttgtcatgataatgaatctgtctcataagagctgatggttttataaagggagttcccctgcacatgccctcttgcctgataccatgtaagacatgactttgctgctcattcaccttccgcagtgattgcgaggcctctccagccatgtggaactgtgagtcaaacctctttcctttataaattactcactctcaggtatgtgtttattagcagtgtgagaacagactaatacagaagtattctaaacacttcacaaatattagcttatttattaacatcctcttgtgttagtgcatagatactattattgtccttattttacatacagagaaactgaggcacaaagaggatagttaaggttcataatcacatagcaaatagaagagtcaggatttaaactcaaatctgggtaatctggaatccagaatacaaactcttaaatgaatacataaatcgaaaccccaaaatgatatatatttaaaatattttctcacatatgattcaatattttccttttcaaccatgctcttctgagaatttttatgttttaaacaaaggacattcgtttcttaaggggtaaaaatatggcttagaataaaatggaccttagaatgggctaggatccattctttaatctggaccctaacactttgggaatctaaggaattacaataatttcgaacctaagcctttaagaaataagatgttttctaaattctcaagctcatttttactaaatcacatactaaagagatgttccctgtgctatggtggaaattggttgagaaatatgacctaggaatattatcattccaaaagtaaagcttccagaaaattttattttggtagatgaggattagaggaacaagaagaaaatcataacattagggccaatgccaattgcaaagtcctgtattcaatgcagcattctgaggtatagaggggtaagagctaaggaagatgtataagttgttgagctggagagtagcccccagaacctgcagacatcatcatgatgcacaaaaacaagcggagagattctagacttctggggatcatggaatatttgaagaaaaccgggagactagaagggtctggaatcacaatagagggattgcgactggacattttggtgcttgtctatggcaggtgggaacaagctgctcacaagaaacaggcaagaccagctaagcttcagtggaaatcaaagttgaacaccaagagtagaggtcagagcagaccttaatcctgtggagactcgttaagtccagaggacagcagttgtaccaaatgtgtctctagccaatcacattgacacaaacatcctttggcatccaggttcaaggaggacaaaagatgagctttatagaaagaggaatacctaataggatgggaatgttggctttgttttttgtttttgttctttattgtatgaacagtttgagttaaaaaaaaagattaaattttaacttgggcaagctgacaataatagaaactcaagagaatttgaaattttcctgtaataaataaagaggaatatatatatatacacacacacacacacgcatatatatatatgcacacacaagatgaagtgtgggcacatttgcaattctgttatctaagagaagaaagactaagaagcacagaggattgtgagtaaaaagaggaagcaatcatcaaggcttccttttatattatattgaaggaaatgctgagtaactttagacacagtgcaaaatattctagcaatttaaaaagatcaatatgaagatagagtcatgcatgtaaaatttgctgagatatattggctatatgaccaaatttcattcccatgtgaaagaatatatttggaaagcaatgaaagtctatacacagaaatagccatttccattcactggaggaccaaggaaaaattaattacaaggtctgagaaagtgttaatctgccatagtgcttttgctgtctataaaaatggcaacataggtttgttactaacttgtacatttggctgacatattatcgaataattttgcaagtaaatctcaccattcaagtctctctaaagggaaagaataaaggaaggtatttatagtcttcttgcaatggttcggtggaaaagaaaaggctacatgtcttccattcggctttagagagagagttctgtgaatagaaaattggctcttttcctaattactctcctggaatcagctgctgagtacaactccataatctacaccatccaacaaaagacatggcaaaggttaagtgattttgtcctatatccaagatagctttcatatagcttcattgttccttcaatgaattgagtcattcactgaaaatgcacacttttactgtgttccagatttattatctaaggtattaatctccacttcaccaaactgaaatacagaaggaaaatgtaaaccacaccaaagtgaacaactgtagcatcctgttgtttaaccaatcgcttatgtttggccagaggcatcaatgaaagagacaatgaaaaaagagaataagtaaaaacttcaaatgttgtgtggtattagcatatattattctcatcccaaatggcaatctttacctttaagtcccaataactaaaggaaaattacttgaactggtggtacacacatttaggtttacatcttaagtgaaagctgatatgtaaaacctctaacctttatttctctgataattgtaatatgtatttttttaaataaattcaagccaaattcctaaaagcagaatcatggagatatcacagaatgtatggttcagattcttcaacatgtttaaaataatttagttttattcaaaagccagcataactgtagatagtctgatttcaccactgatatgatattgatcaagctttttgaataaggttgctggcattgtcaccacagaacaaataacgtaggggctgacaggattaaattcactaaatgttgtcaatgcaattcctgacagctgtataattgaataacatctggataccagactatactcttgtctttcttgttgaggtgtgtttgccatatagctcatccttttaccagtagtccaatcatgtacatcaactcagcgaatttattgcttctgcctgggacacagtgatttccaaatgtaccatttttataattgttttctaggcctgaaggcatgacgaggcgccggcaatgcctttctagtagcttattactttttccttgtaggattcactgtttctgactgggttagcactttctgtctaacactttactgtatcatacagtatgctaggtctcaagccatattggagccaacaagaaaaaaaagaaaagaaaaaaaaaacgatgaaatgcagctaaacagttttactgactgacatcttcttgtctcttttcattcacagagtgtgaacccctggagttttacaatcatttgaaattcaaaggcaaatgctgagagcacaccatcatgagaattggcaccaatgaaaaagtttgtcaaaatcactctggcactaaaccactgaatgttttcaacacaaatggaaagctgacatcatttatagacaactcatggaccaacacaaaggaaaaaatgtcagatccagtgaatttcttttcttgtaattactgtatgatttcaacattggcgtctgtaagaaatactattttcctctgaagtgttttctgtagcattattttgtttaccatgggaggtttgtcttctcccattttccttagaagttgaacacacattttcaaagcctgctagtgattttgaatttcaaaagcgattacaagcatgattcatgcaatatgactcatccctctcaaatgctctaattgtataaactatatccttcaaagcgtcttatggacacattaaatattagtaaacacattttcaagtgccaaaaggtatggttccttcacacttgctgataagactgtaattgatcctctaatttccatgtatgattcaaaataaagctaagactgtggtaagtctcgcatttttaacattaaacttgaacacaccagttctgccactgcagtagccacatcttgattcttaacagcagtcaccttcacctccataatttcccttttgttgcttcaaattatttgttgtactaagcacactttctctaccaataaattcatgcctcttattacagtgtaagtttccatctcttagtaatttgaagaataaacggtcattttccaaaccatctaaagaagacctcttcaagtcactatcatattatattactcacttttattttgctcaggacagtgtaccgacagtcttccatcattaaacttaaaatttcatcagggcaggaccctttttttaaaaaaaaaaaagttgatttaactttatttttaaattcataagaaataattgaatatatttatagtatacagcatgatattttgatatatgtatatgttttggaattgttaattcaagctatttaacatgtgcattatctcatagaagtatctatttttgtggtgagaacacttaaaatttactctctaagcaattctcaaatatacaatatattgtcattaactgtagtcaacaagatgtgcaatcgttttttggaatgtatttattgtgtgtaactgaatatttgtgttgtttgattaatatcctcccattccttccatcccctagcctttaatgactactattttactttctgtttctatgagtttgattttttttacattccatatgtaaatgagattatgcaatatttgtttttctgtgcctggcttctttcacttagcataatgtcttcctggttgatccatgttttttcatatgacagaacttccttcttttttaaggcagaatagaattgtattgtttacacacacacacacacacacacacacacacacacacacacacacagtctttaaccattcatctgttgatagacacttagttgattccattccctggctattgtgaacaatgctgcaatgaacatgggaatgaagatatctctttgacattctgatttcatatgaaacagaactcttttgtatcatgttcaaaactgtatctgccttcttttctctgcccaggatgtaaaaaaagtggctgatacttagatgatacttggagaatatttgttaaatgaataaataaataatgaatccactgttgagaatgagattagtcaactaaagtcttatccacagacaatgttctgagttgagactgattgtggttaggggccatggaaggtgattttacttcaccattcttaacagcatagccatatgaaaggcaacattcaaataaacttgacatcagtatgattttggggactttctctaacattattcatccatataggagacaggagatattaaaggtaatgaccaatttttgatcagacagtcagaagtactatgagtagcccacaagagccgtatctagaaagaatataatgcaagtcccaaatatgaggcacaagtataatttaaattttttagtaatcatgtcttagtaaaaagaaagagataaaaatagttttaacacagtttagcccaatattttcaaaaatataatttcaacatgtaatcacatataatactatcaatgagatcatttacattcttgttttcacactaaatttctaaaaattagagtgtatttgtactcatatcttaattcagactagttgcatttatgtactcaatagctacatgcgtgagtggctatcacattggatagaatacagctgggatagggacttattattgggattagattttacaccattattggaactggtagagaaaaccatgcaagattttaactgcatgcttattgttgagcttgatgtctctaaagtcagccaccagactggcaactaggaagaagcatttgtgtgtgtgtgtgtgtgtgtgtgtgtgtgtgtgtgtgtgtgtgtgtagaatgaagaaaatgtgaaatacatgagaacaaactgaaacatacatatgatttctagcatagccagcctagaagccataacttgcaggagaggtcagtatcctttgccatggatgaggcattcatccatgtggttgagatgttaactctttatagttaacattatcttattggggtaaatatataactcttaaaaatttcaatattttatctgagtcgtttctccctttacacaggattttgtttccagttcttctgtccaagagattgtgtaaatttactggggagatttttatcgctcttaaccattcacgtggttgagacctcagaactgccaaaggaagagaactggtgtaaggtaaggaagataccaccccacatttacaaggtaagttaacagatcagtgacagcacgtgccagatgccagcatttgaagcctgcatcaaactttagagcataaaaatatggcatattcctttactcctacctttcaaatctcacgcaaaatgttgtctgtggccaatgcaaacctgaaaccatacagggaatgaattctgaaaaatgtagtttaattttaattaaattgagagaatataaatgcaccataggcaagcagggaagcttactcaagtatttctaggtcctgtcaaaactggaataattcgttagaaataattattattttcaaataacattattatttccaagaataatcatttttttttggaaatcagtattataacacagaggtttgaaacggatgttctagtaaaacctcttgtagtgcataatcagctttgacaatgagaaattaatgcctaacaagcgtgtatttgtaaactcctcccttccacttttcatcttctcctgtttctttaactcaaaactaaagacacaaacataaaatcatttaactgcagagatactgaagattacagagaatcacctgcagagcctgggcaggattgatgagtgctgatctcattgcacgttaaagttctaatgttacttgttaaagtaaaagtatcataggcttttagaactagaaatcccttttcaaattatcaggttgaacctctagatatggaactgggacccagaagcatgaattgagtgacccccaaactctgtgattatgcagcaattcagcaaaactaggcctctggtgttcaactaacacacaatataactgaaataaggtaagaaaagcagacaagattaccaactcaaacaaggattgctttgctggttaagcctaagccaccacggatatataataccaatttgtaattactacctaaaatactattaataacatacctggaaatgggcaaacgatgtattaagtgactgtaggcctatggcacatcctaccaaggaaaatacagatgttcaagaggtataattttatttgtgacagaattatatagaatatagcatgaacaacaggatgagtgcatgcataatagcatgaatgaatggataaccttctctccactttactttattctcatttttctttttttccttcagctttcccattgagatagatcattacacaaagatcttcaatcacccagctttgggctgaatcaggagggaaaggtataaccactgaagcacttgaggtagaagcaaagagcaggagaaggcatgtgccttgattccagtttgtttttctgctgctgtcagttggctgcatagagcagatgtggtgctgtgatatgttttggcaaaggcagggacggagaaagtgattgtcattctccctcagctcgcaggcaatagagaatggatattactgtggagcaactttacccctgagattaccactgtgagggaaaatcgccttgtaatgagcattggatggaaaactggtagtcaaatggaagttgcagccaagcctgagagagtctgaaacactgttaaaaaaaaaaaaaagtgaagtgagtagtactatctgtatcaatggggagatatcctagatcttccaaaacaattgacagcctaggctgagagaacaggatacgagttacaatagtctttggcttgtcttcagtggaagcaacaagggcagaaatcaatgccagctcctaaagaaaacagcgataacaatctccccagtaaatttacacaatctcttggacagaagaactggaagcaaaatcctgtgtaaagggagaaacaactcagataaaatattgaaatttttaagagttatatatttaccccaataagataatgttaactataaagaggctgtcttaaactgggagggtctgttctttcaactggacaggttacctaatttctcagtgcttcagtttcctgtaggtaaaattaagatcattgtatccatatttaagggagtttgacaataagattaggttggttccttatggaaaataaagttcctttttttctttcaccatatgggaactaaagtgaataaattcttcactgtgtgttttgagtatgatgagagagtatgattaatatgatcaaatctgcatgatgagtatgaacatgcacagttttttgtttgatccccctacaggctatggattagcaaggctgagtagagagggcggatcaagaggagtatacaaaggcaaacaaggctgagaaggccaaattcaaaagtaacgggaagtaggcaaaggcagatggtgaaaggaataggccagttgttgagcacatacatattagaatataggactgagtgcatattctattcacattgtaaattaaatattaatttattataaaaagaatagctactcactgaaatatttcaaatgtacagaacacaaataaggcaaactcaccctacaatataaatcatctcgtccctcttgtcccatggtttatatgattgactattctcataaaaagcattgcagaagaagcatttgtgccctttcatatatatatatataaagattttataggccaggtgcagtggctcatgcctgtaatcccagcactttgggaggctgaggtaggcagatcgcctgaggtcaggagtttgagaccagcctggccaacatggtgaaaccctgtctttactaaaaatacaaaaattagctggatgtggtggtgggcgcctgtaatcccagctacctgggaggctgaagcaggagaatcgtttgaacctgggaggtggaggttgcagtgagtggagattgtgccactgtactgcagcatgggggacagagtgagactctgtctcaaagaaaaaaaattataaatattacttttagtgacaaaacataaggattatataatatctcataattgacttttcatttttttcaaagagattttttatttgaagagtgatgattttttgatgtgtcaacttggctagcctactgtctttagtaattggataaacactacttttaatgtttttgtgaaggtatcttgttgatgtgattaaactccatagtcagttgatggggagagtagcctggataatcaggatgagtctgattagatcagtaaaaaggcctcaaaaacagggatgaggattgcctgatgaaaagattttttccctgtgcatagcagctttgcttatatccacagttccagtcaacccttctggatggcctaccctagagatttcagacttgcctgcctggcttgtccctaaatcacgtaagccaactccttgcaataaatcccttagtatatatttcccattggttctgcttccctgactgatacatggaggaagttgtactttatttatttatttatttatcttttttttgagacagagtcttgctctgtcactcaggctagagtgcagtggtgcgatcttagctcactgcaacctccacctctgggttcaagcaattctcctgcctcagccttctgagtacctgggattacaggcatgcccagccaatttttgtacttctagtagatacaggatttcaccatgttggtcaggctggtctcgaactcctgaccttgtgatccacccgccttggcctcccaaagtgctgggattacaggtgtgagccaccatgcccggcggaagttttactttatagaaacaacattgccactggatgtatttttgaagtaggaaataaatgaccaagagacactcttctgccttgcaaatgtatgaagtggatagaaaaaaggggaaaaagcctggaaatgtcagagaaacagaaatactgaggacttgccgccatgcttaccaaggaggataagagaacatttctggaggataagagaacagccaggtgcagtggctcacacctataatcccagcacttgagagtctgagatgggtggattacttgaggtcaggagttcgagaccagcctggccaacatagcgaaaccctgtctctactaaataatctgtaatctactcaggaggctgaggcaagagaatcgcttgaactgggaagcagaggttgcagtgagccgagatcacgccactgcgctccagcctgggtgacagaatgagattctgtctccaaaacaaaatataaacaaacaaaaatccgggagcagtggctcatgcctataatcccagcactttgggaggccaaggagggcagatcaagaggtcaagagttcaagaccatcctggccaacattgtgacatcctgactctactaaaaatacaaaaattagctgggcgtggtggcaggcgcctgtagtcccagctacttgggaggctgaggcaaaagaattgcttgaacctgggaggcagaggttgcagtgagcccagatcgcgccactgtgtccagcctggcgacagagggagaactccatttaaaaaaaaaaaaaaaaagagtgaggaagaagatgggcaaaagaaacaagttctgattgctgaatagaaacaaatatttcagatttaacgggccagggtaactaagagctgagattttccatatggtctgtaagcctataatgtattacaatcatgttgccttatatcagctcaaaagctttccacatccatttgcagctggactgcttgaattgcctctctcttctcacgctaggtacctatttctgaaacaaggcagaacattttgcccctgaaaatgcaaataaacttcccccagtagaggcccccactcagaaatgataaatggaggccttgaagtgtttcctctagtgaattacatattagaattacactttctatttctgggaactttgcattctcacctattgccttgttcaacatttgccgcctctggctgcagaaactgattaggaagcaaggccaattggatatttgaaatgatactttattgacttttttttttttaataagggagacagccagcagagaaatgtgtagcagcactctatttgcctgtagttagggtcatatcttgttttctttatttcatagtagcaagctgtgaatactccatgcttccctttcaattatactcagctaaaatatattgggtgttattcattttaaaggactgagggaaaagaagcaacacctggttgcaggcactttgctcattgtttgataacccttaagtatcatcagaaagaattctccaggataaacatcaacatagatgaggacatcacggccacagagataaagtgtgatatccaaggtggcaaagacattttaactaaggcctgacctcctgttgttctaccatcttatcactttaagtaatgcatatattctctaagagtcacatttaaattaagcccattttactacataagcttttaaataatctgataaaataattatatcctgaaaactccttttatagaacaaatgccatccttattggcctcatacatctccttttccatttatcttttctttttaattttaagaaaactataaaagaatctttcctgcctcagatatcccctccattagctgtacctcctaaggtctggtaagtacaagtaaaaggaacatttgctggagctaaatgaaagtagtggccacatctctcacgtgtttgtgtaccatctacagaggagtttcctactagtaaggacagtttgatcactcctagacatggagtacttaaaccaaatacactttgtatatacataactcctctcctcctcctatacttacaacccgaggtagtcattacgatatctaaaagaaaaataaatagaagaggagaataaaaacaacaattttaggaatgactatgtgaattgtctcctaactttatttgattaatttagcttttttataaatttctagacaatgagaacccaatctacttatatttagcaagtctgcataatcacccaaaaattatatattagaaagcgtctttctttaaaacaggaagtgttagctcaaacgagataagatgtgaacaaataatcataatggcataatacttaaatatattttatatataaataaggtaaatctaaatttcttatccatctatgcgcatgtttagatcaatatatacttgacttctttttatagctttggtatacaaattgtttaatgtaagaaagaattgaaagtactatttttccttttgatgtttttgaaatctagtttcaatttcaaatatttaatttctgttgtgtgatgaaaaataggtcccccaaagaaaaattttttttgttttttttttcaaaagtacatttcacttaaccatgtaatgctaagctcttgattgcttttttttttttttttttgtctttgttctttatctgactgtgagctggtgaaaagagaacagtcagggaataaagacttctttgataccagcaggactcctaagggttcttttgtttgctaatggctgggattttctcatttacatcctttcagggaagaaaccatgtagctgccatatcatatctgtgtctggataaccttttgcactagactgctctgtatggatggattaacgcatgatggctattgactcagacttctacagcattcctctgagcagaaggcagaaaccaaccttttgcatttctggtgataacatcagcaaccaggccaatttcaagaatcattagattttcattatgataagaaatataaacatcattctttcctgaagttaaattttgaattactaatagttcagaagtacagctgaaggtttaccacaactcagaaaactttctaactaaagaggaaaatataattgttaaagtttaaagccctttaagaagtttaagttctttgatgaagtgtaacttgcacataataaacaattggtatgtcacattattattcttctttcatgaaagcaagttctaatgaactttaaggtacaggaatattttagtctaattttacaatggatttgtgtttgaatgtggtaatgcataatttcattaaatattttaaattctgattattttcatttagcccattacttcagtttctaaagaaaaaaaatgaaatatcttgtaacagaaatgtagtgaatttgaatctctagtctcaaatctcacacattggaaggccccaatctgctgtacacttcacagtgctatatgaaaaacttcttgaatgaaatatggaaactcaatttttagacttgttatagagagtcagaatatagctacactaacaaatggatagtactgagttttacaaaatggaatttattcaggaacatactattggatactaagcttgtcactgctctacaaaaaaaaaaaaaaaaaaaaaaatataagaagaagacagagtgtattgaccctgcttactgatatctttgccattgttaagccctggaaggccttaatgccaggtatgcaacattgtgtagtatctaagagtactacctcttcagtcagaatcatgaggttttaatcacaaatttctaactttctatgtgacctcaggaaggttataaaccttttctaagcctcagtgactacaccagtgaaataatactataaatctcatggaaggagctgctgtgaagatacaatgaggaaataaatttaaatccttagcacaatacctggcacacagtaattgcttaaaatggttagcttgtattattaacactgctaaccaagtgataaaaattacatcagttgcagataaagccaatttcttgtttcagatatatctaaatccattttaagacagactaaacttggttataataacatattattatattaatgatacttattatgtagcaatagataactgaaccagaaaatttttatcaaaagtgaggctccaatataataaaaattttaaaacatgtagcactggctttagtactgggtaatgggaaaaggttagaaaaatggcaaagaggctgtgggtgaaggttgaaagaatgtcaaacaaaatgttagtggaggctcgaaaggaagcaaataaattattattggaggctgaaaaaaatggtgacctgtgttttttgatagcaaaatagttggaaaatttatctcctaggttacttggaaaacataaaatatacttaatgaacttatgaatctaaggatgtgtctaggatagatattataaatgtgcttctttttgctgtatgtaacaaggtacaggaagagaaagatgaagaaaggtagaaattttcagtttataagtagtattaataaaaaaaatagaaggcacagaactcttttggtttggaaaaataaaaaataaaaaccttaatattctctagtgtctccagctagccaaagattctcaaagtaagaaatggcctcacaataagaattaaatctagtgtagttgtatgatcctctgctaatattaggttggtgcaaaagtaattgtggcttttgacattaaaagtattggcaaaaaccacagtaacttttgcaccaacataatactttagaaagatttatggaggtacctagcagatcccatcagctacacaaaaaggtttctaagaatcgtacatgtgttgtccctctaaccctctaccaaattcgacagaataatctatttttaaaaaatcatagatctgacatttggggcatgatataaacacaaattacacactctcaatgtttttaaggtagtaacataacgaacaaaaagccagaggtagttcaaaatgaaaaaatatctctatgcatgcaattttctatgacaatgaagcagcctgagaaggtcaagtagatactctgctcaaacactggtcatttcttaaagaaaagaaatggtatctctcagcgtagagccatgagtgaagtcaacaacaacgaagatgctgagaattccatgtccaaggaacagaagcagactaaccaaggatcattttctgtccatggattggggagtactgagaaaatataccaaactattttcagaattgttatggactggtgattgacttcgaagtttcgaatttttgaatgggagcttctattactgttatcctgtatgtgtctcaccattatatgcttggagcatgaaggtatataactcagtttttcagtttgtgggtccctggaacaataagaagccactaaaggaactgcaggcaagaaacttctctgtatctatctatctatgtatctatctatctatctatctagccttatctatctattgccttatctatatgtatagccatatatatgtatataatcagtgatatatatatatcagtgatgtatatatcagtgag

SEQ ID NO: 51 - DNA, 1171 bp, Homo sapiens
gagaaccaattctttaccagttataaccggagttatgttaattctctaaatgccatgccaagctaaaaatgtgcaaaaagaaaacataaagggaagaatgaaaacactgttagaaaggtaaataataacattgttattgtaacatattttacaaagtaacgatcaccaatcacagtgaatatctgtaggctaaaacttgcccctgagaaacaaatcacaaaataatggaaaataaaatttttcaaaagggatctgcagtagattatactctaatgaaccacttgattttataaattccattaataattttaactgtacatttctcaaccttttgtccttagggctcagccaacattaagtcaactaacaactacattaacaataggcaagagaaaagaatagtgtttactgtggttccaaagggattttccaagcagattcactggtaaggaaaaatcctcttagccattgttggctttgaaaatgtttgtgtagtgtgattctttgcttcttaattaacccagtcactgactacttaggcagtgtgctacggcactgatgaggtttaaaatagtagttttctaacaaaaaacttcagactgaagaagtataatttctgatatccttaaaatgatcaaaaaatcactttaaagcatcctttagaattgtattaatctcaaattttcacacctgttgtaataagtagactgtattttttgttttctcttctttttctaaaaaataaaaatatataatatatttatgtagtacatggtacttttttttttttttttttttttttgagatggagtctcactctgtcacccaggctggagtgccgtggcacgatctcagctcggtgtaacctccgcatcctggtttcaagtgattcttctggcccagcctcccgactagctgggattacaggtgcctgccaccactcctggctattttttttttattttttatttttagcagagatggggtttcaccatgtttgccaggctgatctcgaaatcctgacctcaggtgatccaaccacctcggcctcccaaagtgctgggattacaggcatgagccaccatgcccagccacatggtacaattttagcagttctgaaataaaccaattatttctttaaaaaatattatatgttattaaacataatttc

SEQ ID NO: 52 - DNA, 13160 bp, Homo sapiens
gctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggca

SEQ ID NO: 53 - DNA, 11687 bp, Homo sapiens
acgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggca

SEQ ID NO: 54 - DNA, 6925 bp, Homo sapiens
tcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtac

SEQ ID NO: 55 - DNA, 513775 bp, Homo sapiens
tgaaaaacaactgccgtcctcatagtcttcaatttacaaaaaatcatcttgttcttccaaattttcgataagttcttgaaatttcaaatattttccccatagtaacctttgtatctgatcaagaacagtgatatattatatattgacaataatatttttatccatttatttagtatatatatcaggggtatatttctatgggaaaggaatagacaaatactgacttttatgtgtcagaaatgctattgtatttaataattaaaaacatgctttgagacatgcattaaaattattgatttattgataagacaaaaaattcaaagagattagtttctttaattactcacaataagaaggaagaatgtgaatgaaatataaaattctttcctatacactcctctattttattgttagattatttagaaagtaaaaacaagaatatcatgctgtcttcaaagaaattatattttggtcagtggtataaatcatgtaaattaaaatgtattaagtgcagaaatatgtacaaaactgtagatacacttccattttatttatttattaggagacagagtcttgctctgtagcccagactggagtgcagtggtgcgatctcagctcactgcaacctcccaatcctgggttcaagtgattctcctgcctcagcctcctgagtatttggaattgcaagtgtgagccaccatgcctgaataatttttgtatttttggtagggaaggggtttcacctcgttagcctggctggtctcaaactcttagcctcaagtgatctgcctgccttaggcttccaaagtgctgcagttacaggcatgagccactgcacctggcctatagatacactttcagagaaaaaaagagattattttggtatgagatgatgaatcaaaggattctttgtaaaaagtttagaatttgataacagcagacacatatcagatgaaaaaatattttatgtgcaagggatattgtgagttaaatcagtggggtgggaagaatttaacgtgtggcttttaacgtaagaataataaacaatttgtaagtattttatataatccagcatactctgtatgaaatggagaaaactttttctatcaaaatgctgtaagaggaaaaatattagagcaactattttcactaatatgcttaatcacataatattaaaaattttggaagaaagtttccatcctacatttccattaaaactaaaataataaatttcaatgaaaataattcctacttgagttttgcaaaggagaaacttgagtcttattactataattttcatcattttaatatacaattttaatggttttttaaataaactttcttcaccagatactaaatattttatcttacttttttctcatttataaaattcctttggggctgaggaaaaagtgcttttcaaactttacagtattttataaacaacaaaggtagcattttatctgctaccattttacacttcactgctgcacagaagtgaggaggcgaagtcatttggggatctgggcattcactttcttacaagaaggttactttccaatattggacaagtatagagttttccaaagaggcatatttcattcaggttgcacaatcagtgtcaaggtcccagaaggtcattatccttttcaagtcagttggaatgacatctgcctcaagcaacctagaggcacagctgattgttctatagtaagaatataaacacttcctgtaacttatgtcagtataagtctggtggtagaagagatgcatttgggaagaagaagaaatagaaagcaagtttatttactttaaatatacttataatattttaagtttattatttaaaatattacaaatggaaatatatacacatggctattaaaataagtgtggttttaaatttcaaagcctcattgaagagttggatgacagcaaagggaaaacacttaagtccatgttcattgctaggtttctagattttatttcttacaatactgcttatctttgcataaaaaatgaacaaatcaaaaccatatatatacatacatattatgtatatatatatgtgtgtgtgtgtatatatatatatatatatccccagtagagaactcataattcaacctgatacttgttattcttatttttgttgttgctgttataagctctggtccaagcctggacaaaacttttactcccaattcccattagcatgaccatatgctatatttctttcctgctcaacaggaaataatacgcaatgtggtgcttttgcttagaggagctgtggaagatgcaactaaaacaaagaagagagtgtagattcttacaataatccaaattttggctcacattattttccaagctttccttaatgatttaaaagaagatctcattaatcctcttgcaactggaaaatatataatctattccacctcaaaagatcacaagttgaaagggaaccagatcacagaatcaaagctcagccgatagttactccatactataaaatatacaattttattaaaattggagcagattcctgaggcagatattatgattacagtttagtctgttgctgtatgtaaaataagacgtaagaccaagttcggggctttgctacctactgataattgcagagtggctggtgggtacagaacatgagaaagttgtgtggtttttaactatcctatcaccttccttaaaaataatcacttcaagctgggcacggtggctcacgcctgtaatcccagcattttgggaggccgaggtgggtgaatcacttgaggtcaggagttcaagaccagcctgaccaacatggagaaaccccgtctctactaaaaatacaaaaaaaattagccaggcctggtggtgcatgcctgtaatcccagctactctgcaggctgagacaggagaattgcttgaacctgggaggcagaggttgcggtgagccaagatcatgccattgcactccagcctgggcaacaagagcgaaactccatctcaaataaataaataaataatcacttcattcaactcagatgcattaatagatttgctttatattttttaatgacttgcttagaaacattattttcttacataagcccagtaaaagagaataaagctttgatattgatgataaatttagagcatgtacaattgttatttactctcttggtgaatcacaatttccatgatactacaattgacaagttaatttcactattttaatgatcttcatagttcacaaacacacacacacacacacacacttttctttattctttaattacaaagacaagatacttttgctgatcacatttgatacggtttcactgtgtccccacccaaatctcatcttgaaatcccatgtgttgtgggagggacctggtgggaggtaattgaatcatgggggcaagtcttgcctgtgctgtacttatgatagtgaataagtctcatgagatctgatgcttttaaaaagaggagttcccctgcacaagctttctctctttttgcctgctgccatccaggtatgatgtgacttgctcctccttgccttccaccatgattgtgaggcttcaacagcaacgtggaactgtaagtcgagttaaatctctttcttttgtaaattgcccagtcctgggcatgcctctatcagcagcgtgactaataacagtaaattggtcccaagagtgcagcgctgcagaaaagatacccaaaaatgtggaagtgactttgaaactgggtaacaggcaggggttggaacagtttggaaggctcagaagaagatcggaaaatgtggaaagtttggaacctcctagaggcttgctgaatggccttgcccaaaatgctgatagtgatatggacaataaagtccaggccaaggtggtctcagatgaaaatggggaatctgttgggaactggagcaaaggtgacccttgtcatgttttagcaaagagactgttggcattttacccctgccctagagatctgtggaactttgaacttgagagagatgatttatggtatctggtggaagaaatgtctaagcagcaaagcattcaagatgtgacttggatgctgctaaaggcattcagttttataaaggaagcagagcataaaagttcagaaaatttgcagcctgacaatgtgatagaaaataaaatcccactttctgaagagaaactcaagccggctgcataaatttgcataagtgacaaggagctgaatgttaatccccaaaacaatggggaaaatgtctccagggtatgtcagaggtttttacagcagtccctcccatcacagacccaagacctaggagaaaaagtggtcttgttggatgtgcccagagtcccggtgctatgtgcagcctagggacttggtgccctgggtcccagctgctccagccatggctaaaaggggccaatgtagagctcaggccatagcttcagagggtgcaagcccaaagccttggtggcttccatgtggtgtcgagcctgtgagtgcacagaagtcaagaattgaggtttgggatcttccacctggattccagaggatgtttgaaaatgtctggatgcagtggcatccaggcagaagtttgctgcagtggcaaggctctcgtggagaacctctgctagggcagtgtggaagggaaatgtgaggtcagagcccccacacagagtccctactggggcactacttagtggagctgtgagaagagggccaccgtcctccagaccccagaatggtagatccacagagagcttgcaccatgcacagagaaaagctgcagatactcaatgctagcctgtaaaagcagctgggaggcaggctgtaccctgcaaagccacaggggtggagctgtccaagaccatgggaacccacctcttgcatcagcatgacctggatgtgaggcaaggagtcaaaggacatgattttggaaatttaagatttgactgcccttctgcattctggactggcatggggcctgtagcccgtttgttttggctaatttctcccatttgtaatggctatatttacccaatgcctctaccccaactgtatctagaaagtaactaacctgcttttgattttacaggctcataggcggaagggacttgccttgtctcggattacacattggactgtggacttttgagttaacgctgagaagagttaagactttgagggactgttgtgaaggcatgattggttttgaaatgtaagtacatgtgatttgggaggggttggggcagagtgatatggtttggctgtgaccccacccaaatctcatcctgaattgccatgtgttgtgggagggacccggtgggaggtaaatgaatcacgggggcaggactttcctgtgctgttcttgtcatagtgaataattttcacaagatctgatggttttaaaaagaggagttcccctgcacaagctctctccctctttgtccgttgccataaagtacattatatttagaagacaaagaataaatagagaaactatttaggaatatcatgctaaaaagagtgttatgaatttgtcttctgagtttctatgaacatcagtagcaattcatcaaccaatatttaagggccaaatatgaatcaaaatctactggatatttatattcccattacattgattgaagcaatgagtattatttggttgtaatcaaggatataattgtgcaaggtcatgcagactgagagagtaccttatcctgaaagcattatttttaactctcaggaaattatatagttaattagagaaacttgaatatttaacaaaattaggagaaggaaagttttcttgggagggaaagtaaagtgaatatgcaagataagcaggaatcttgtagactatcttgtggcagataccaccattatttctattttagagataaagaaataaaaacataaagtaatatatctaaagatgtgaagctaatcagtaccaaatactagcaagaatgattaaaaagaccctatcaatatcagaaatgtaaaatatcaatttatgtctaaaagcatatctttgtttatgtctaatacatatccaaggcataagaaatagagaaaactaaatacagcaaaatattgtaataaaataatctttatataaaaaatgatacacttacaattcagttggaaatatataaaaaaattcaagctatggaaaactttccattgtggatttatttcaatttttagatatgtatcaagaaataatttataactttagagtcttacttaactgaagcatgatattttaaatttaaaggtaaaatagaaattatgtgaatccagagttaagtagtattatgttaattgcacaatcttactagaattaggaaatgaatgttaatttgaactatggcatatagtcaagcttttaattcgtatttctttcacaattctcattaagaattagagctgatctggctttttacaaatcatcaacattgccaagatggtttggaatagtgcagtgtttcagagcagagaggttcataaggttttattaggtcccatgggagaacatcaacttgttctattctcccccaagaaacaaacaaattcactcagtgaaaaatcctctgtgagtggatctttgcacactgataaggagatggtacaatagttggcattatagaactttgatgatgtggaagaaacacatggaagtcatactttctgggtaaatcaacaaggttagttagacacaaataaacatatttttctctacgagactaattttgtagaatttaaattccacttgtaattatagagaaaaaagtggcaaaatatatactgtctgcatttattcttgaccaagaaaatcctgaaaagtataatactaaaaaatcgaaaaggaaatgctcacgtgatgtaaatattaggaagtttccaactcgggaattgaggtattacagaaagactaggaagcagctacctacatcaaagcagggtgaattaaacagaagaaatgaggtaccattaattaggttaatgaggaaccttcagtggactggttcttatacttctgaggggaaatggtatagatggagttggaaaagccatgggaagctcagaggtttcagctgtagatttgttcttttagtcaagcaagccgaaagaaagtatttaccaacctttggtgaatgccttgaaagctactgtttcgcatatgttgttcaatgttttagttttggcagaacggtcactatggtttgggctggcattggaagtttagagcaatttgtcttaaaatattttcatttgcaaaattcaacaacactgaaagatgctacaaaatgtagcttgaccccagatgcttatcaaaaatgcttattgaatagcattggagcttatataaattattaatttcaattattaagtattaagatctagtaagagtttaatacaaggtgattacatctttccaaatcaaactaagaacttcttaatcatctttgggtaacatttttggataattttttgtaacattttccaataatggctaatagcatgtctgcttcattttcatagtcagatacctgtgattcatgtgaagaattctcatacatttagtcagagttttatcttattttatttgaaaataaataaacatttttttgccctggaattatgtttaatcttggctccaggagttatgtaataaaccattggtataattgaagacttcaacactggtcttcctattccatatatcttagagttactagttccttctcacttttgaagatttttttttttgacggagtcttatgctgttgccaggctggagttcggtggcatgatctttggttactgcaacctccgactccctggttcaagtgattctcctacctcagcctcccgagtagctaggattacacgcacctaccactacacccggctaattttttttgtgtgtgtgtttttagtagagacggggtttcaccatgttggccagaatggtcttgatctcctgacctcgtgatccaccagccttggcctcccaaagtgctgggattacaggcattagccaccacacctggccacttttgatggatttttaaaatttctatatgactttatgtcatctaaattttaactcaaatgcactcgtgttaatttgttaacattttattttttatttttgcggctacataataggtatttatatctgtggcatatgtgagacattttgatataagtatacaatgcgtcaaaatcacatcaggacaaatggaatatccatcacctcaagcattcatccttttttgtgttacaagcagtctgaccatactcttttagttatttaaaaatgtacaatgaattattgttgactgtattcaccgtgttgtgctatcaaattaccacaatcagaataacttctcaacctgtctccatattttacactgatgttgaaaagtcagttccacagaaagcaatatttcaattcaaataataaattacagtcttgttaaatgttatttaaaatattacagtgaagaatatgaagagattacataaaattttccccaggtttaaaataatactcaaatgcctaaatatatcagagctatttctaatgatgtatttcagtttgtatatctttactcacaaatattatttgaaaaataagacaatcttctatttctttatacatatttacatatgtaagccattacctattagctggcaatttttaaaaaaacataataggaatatataccttttaactttatcattcattgatactattgactacaagaataaaaatatataagtaaaaatatagattttatataaccagcgccaaattatatgtgcatttatcaaacttttggaggcttttacatgagaaggctattacaatcactcaaaaaattttagaatataaaaactctctaatttcaaggaatgtaaatcttttaagaggcaggcaagtgaaaagttgaatcaaattagaggaaggtctatatcaaagtaatggataattattgaattttgagaatttcttattaaaaatattacttgaaactgtctctgtctatggcttaattttttgtcttatggtttttgaaaagcatattttatttttttaaatttaaacaatataattaagtacaaattataaaacccttccattggctaaagttatcaatttacttttcattattatgggtacataatagtgtctatattaatggggtacatgtgatgttttgatagtgacatacaatgtgtaattatcaaaacagggtaactgggatattaatcacctcaattatttattatttctttgtgttaggaacattccaagtctactttttcagttattttaaaatatacagcaaacgactattatctacagtcactctattgtgctactgaatacttgatcttattcattctaattgtatttttttgtgcccattaaccatttcccctctatccccttgttctgctacccttctcagccactgaaaaccatctttctactttctatctccatgagtttattttttcagcttccatatatgagtgaagagatataatatttgtctttctgagcctaatttacttcacttaacataatgtttttcagttccattcacgttgttgcaaatgacaggatctcattcatttctatggctgaatagtgctccattatgtatatatactacactcctttgtccattcatctattgatggaaaattaagtcaatttcataccttggctattgtgaatattgctgcaataaacaattgctgcaatattattgctgcaataaacatgaaagtatagatatttctttgatacactgatttactttctttagggtgtacacccattaatggtattgcaggatgatatggtagttctatttttagttttttttaaaaaacctccaagctgttcatagtggtaatactactttacattccgaccaatggtgtatgagattattctattctccaaatccttaccagcattctttattgcctatcttttgcataaaagtcattttaactgggatgagatgatacaacttaaaatgaccatgagaaaaccgtacatattattggaactaaaatcaacaaaattgatcgtagcccgtgttgctgtggatggagaacaaataaaactctcacacatttgggtaaaaaatcaaactttataaccaccttggaaaatagtttggcagcatcttcatacattgaacataatacctgccagctatttcatccttagatattaacccaaaataaatgataatatatgtccatacaaaaacttgtacactgatcttcataactaattttttcctagtagcccaatactggaaataacccaagtgtctatgaataggggaatggtgaaaaaaatgaacatatccatacaatggaagagtattcgtcaataagagaaaaactcttcatacatgcaacaatattgataaatctcaagaattatactaagtaaaaggagtcaagctattacctgcctccaaaaaagacaatattaaatggtttcatgtatgtaacattatagagagcacaaactattccatactgacaaaagtcagggcagtgcttccttggggatgaaaactaggcagcattaggagagtgagactgaaaggaacatgagaaaacatttgaaggtaatggatttgttcactgtgttaatacaatgcatttttacgtataagacctaccaacttccacaatttaaatatgcacagttaattgtaaaaaaagtatgagtaaatagaaaagaagccacaaagtcacttgacactgaataaatttttcaaaaaagttatcgtagaaaagggaaagtcttatatatgctgtaaaagttaaaggacatgccactagactagatgcataacgtgggaaggaggggagagcattctaggcaaaggaagcaaaggaagaataaagcattaatgccaaggagtgttgagaaggaagtgataacactgggatgaaaaactacaacagggtgaagaacagctgtgaacataacattggtagatagatttatcctctaagggatggcaatacggtaaaagatttccaaaaagttcacataaaaaaatgagtgtcagcgttagtgaaacaaaagtcctggcagagagtaagactggagggagaaaacattaagacaaacaagaatatgcaactttaaataagataaatataaatattttattgttataacaccttataccctattgaccttgtgaactttaaaaacatatgtaaaatataaatcaagaatattctgtatggtgagattatagaatcaaatagcaattcaaagaccccaaattccaaaatgtattctaagtagtataatttttttgttagtaagtgtaaaatctatttcaatcatatctaatcagcttgctcattagaaatagcgtatagtgttttcagctagtaaataagtctgtcacgtttcattattattattattaaagtattattagtatctatttctttccctcaaagtcataacagcctattcactagataaaatcagctaatttttccaacattacacttaaaacaagtctttttttctgaattgcttgatggtgacttttgaaaagaactttcatgaggtagacaaaaataaactgcaaaatacacatttataaaacagaattaaaacaatgatacatgaatctggaattagagaaaataatcagcatataaatagaatctgagaagaagtattacccttgaaaataatggctgtatcatttgtaatatatgtaatactcataacattcatcttgtgggttttttttttgcttttaaacaaacagttttggattttgttgtttcattttattataagtgacacatgtttgtacatatttatgagttaaagtatcatgtttcagtaatggatacattgtataatgattaaatcagtgtgattagcttatccttaacattaaacatttaccaattctttgtgatgatagcattcaagatcatttcttctagttatcctgaaacatacaaagcattattgtcagctattttcacctaccgtgtgataaaacactagaagttattcttcctgtctaactgtaactttgtacctaatattcagataggcaagtaactttgtcatatatgtaacctggtctaaatgaacagtaaacagtgatcggtcttggtttattatgttgactaatagagagatcagtggtcataataatcttttttcaaatgtgtttccatttgtaagaaaattttatttataatttgaaagtgctcagctctgcttttctatatcgttttgataccattgtccacagttgtatgcttttgatgcaaatatttcagattatttagaagtcttaggaaggttaaaattactacatattaatacattatctggcatgtttattataaccaaataaaaaagtttattcctcttttaatagaattttaaacacatgtgagttgttcttgtattcttttatgaaaaatgctcatttcaagagaacacattttaagtcatatttttatcaaatatattaattaaaattataatgtcatttcaaactttattcaaacttaattctcaacctctagcctgcttgtcatgatagtctgaaataataatgacataaaatactctgatgggacaaataaattactctcacctttcttggggaatgagaaagacaaaacagaaaaatcagtaaaagatataaaagcagttttctggagtttattggttatagttacttgtcacaagtatctgtgttcatctgagtctgtaattacgtagctgactctctgaaaagggaacacagtgatgaaaagacaaaacttgaaattacacaattaattgcaaactatttctcctaaggctatatatcacgcctaagagagcctgagcttaaaggttatactactaattctcttttcaaatggtacttttattagccattaaatatcactcagtgtgtgattatttttacccttgtcttagaaattgtgaacctgagacactaaaatgggttaatggctctaaatcagacaatatataaaaatctcaactaatttgtttttgtaaactgtttggatcaagttacatgcaaaaaaaaatgagtacaaagcttcagggaaaaacacattaaataaatgtgtgctttacaataggaaaattataaaatatcagcttttgtactcatcttcttttcaacatctgtatcttgagaatgagtgggctacttctgtagtgaggaaaactcccagtagttaatccgttgctagtcatatatatacatatatatgccatcatatgccatcagacacctgaaattttagatatattattgtaatttatagaacatatttatgttagccaatattaaaaaacgaggatatccattggcttgttaaagaataacatccgaacagtactgcaatgaaagttgcccgctagtaggggtgtgtttttctcacttttataaattcagagtttgaatataatatgggccaatacattgatactgcatataaaataattaaaaatggaacatatcatcaggcagtatacaaatctttcgggatacatagtgttgggtgggggcagaagctacataagaacttaggaagtacagtgggtcagggagagatggtacaaaaagagttatcacaaaatttgcatttcatatttggatccaaacacacacacacacatacacacacacacactcttatacaactggatttggtactttttgatactttttatagacttttttaggaatgtgcccttaacccacgcacacaaaagacctcgctcaagttaactcaacttgtcattacaagcagaagaaagcaaagcattgtggtagttcatcttggaaatatctgtaaggtttttatctgatcagttggcttttttttatgtttttaaaacaaaatagaatttggaaaatgcaagctgtatattatatttgtaatgaattttatacttcaaaaatgaaagtgagtgacttcccagtagtaaatatttaaatacttcaacaattctaatacttaaatagtggattgtaaatttattactgaactaaataaattcttcaaaggtattttatttagtctgtaaaacatttgtcagttacctagctttataatttaaggagtttttcttcatctataataaaaagtttagtctctgaaactattatcataattgtatagttatatgtgtttgattttctagaggagcatatactcaccaaaaagtgttttatatcatcaagaagagtaaaggaataataaaattattaccatattgtagagttgctacaaataatatgctatgctgctgtttcaacaaaactgtctacagtttttttaggcaagtaactcatttcttatatatcagattaatgattatgaaaactgtaaatatgtaaagcaggtatgaagcaataaatttttttctacttagtaaactctggaaacatctttatatcaggaaatgtctttactcttagtgatgtttagaatagccaccctttttagtaatgcaaaagggatgaaaatgccttttacctcatgacttatttcatttaggtcaccatttttatacctgtttgatataagttatttaattttttattttaactttataatattgcatggtctcacttacatgtgaaagctaagaaggttaaaatcttgaataaagaatagaatagtggtttccagaggctggaagggttgtggggaggagaagatgaggagacattggttaatgggtaaaaaataaagttagatagaatcaatacaacctagtgttctggcacaatagggtgactatagttaataatagtttattgtatatttcaaaataactaaaagaacgaaatgggaatttttctaataaaaataaattataaatgtgtgaggtgatatatatcccagtgactccaatttgatcacgataatgcattacattgtaagcttgatttttaaacatacatacattttgaagaatcaaataatctacaaaatttatctattacaaaaacaaaacacagtagccaaccctagctctgttttaatgacaaaaacagaaaaaccaaggagcaatgagagtataagcatgacatttagaaatatagggattataaacaaaagtacacagctatcccaaggtacggtgagtggccagctcctcccttcagctaaggcactctcaaaaggctggcagctcagggctgtttgcaggtggccctcccagcactgggagtaacacataatcctgtactgaaggaggatcttgacagtgtcacgtggcttccatccattccctactttggtgctggatcaccttttgttcagaattgcatattatttcctttcttggtatctcctttgttttgttatatgctctactgtagtttcctaaagtccataggagttaagatttctgagaccttgtacatctgaaatctacacttaactttcaaataattgttagcatgggacataatttaagtttggaaatcaaatttgcttcagaagttaaagtcattgcatcattctctctcagcttcagagatgctgttgagaaatccagtgtcaatttaactttttatcattactatattagcttttccgctttgaattcacctaggatattctctttttcccaagtaatcttaaatttcaggcttatttgccccagaatggatctattttcatccattttttgtctctcaatggggccttgcaacttagaaatttaaattatttgttcaatgattgtctactctctattatatctgtgttctttttaagtattacattattaaattaaatttacggtatattaactatatattcaataatatattaaaatatatattaatgttatcaatgcatatatattatgcattacattattatattctatataatatacatcaggggtattttattaatgtatattaaaattatggtatataacgtatctatatatacatatatatgtttatgttatacaatgtatatgtatacatatacatataggtataacatgtatatacatgtgtgcgtgtgtgcatgtatgtgtacatatatgtagttagcataaagtaaaatggagaccagaactggagaacccctgagtagacaaacccattaaggcctcattagtgatattatattaatcttgcttggtttgtaaacataatttaacttgagctatctctcttatatacccatattaaagaaaactaacatttaaggctaaccaatcaaaagccatcaattaattatagttattatgaatgttgcagcaggatagaccaaataaggctttattggtctatttttggattgataataatgttaatatatttgactttaatgactcaaaaattgtcattactttacttccatgttctctgtataaaagccttcccctggcattccttcagcacagccacttttggtttacagcagccttattcatgaatcactggttgctaaaattaagtatagtattattgtgcttttctttacactttaacagacaaattttatatatagttatatataagcatatatcaatatacatatatttatcatgtataatttgtctatattacatacatatatatggtctacaaaagttctggtctggtttgcaattttaagtttcacttttgttcttagagtgtcacaataatatctttcagtctttctactaaatttcaattctctgctcatatatttaatttaaaaaattcttttgttctctgagtatttatgaagtaccataatcttgtttcacagacatgatagcatttcttttatctctgaaatggtaatgaaagtttttgcttttttctgtttctattttatttttagttacctatcttcacagtctctgttttttccaagttgctttctttaagtttgtctgtttaatattagaacattcctttcgtatctgtgatcttgactcatgtttaagatggagtcattaaatcttatttgagaatttgtacacatgcatgctgtttgtggattgcacatgtggtgacctagcaagacaatattactggaaaatacccagagccaatgtatcaggtcatttttgagggaataatcaggtttctgaaaatataaatctttcactctttagctgcccctacttcctatttgtgtggtattcttcctctcaattgtggtagaactgtggccagaagcactgtggtccagatactttttctacctcgatgggtaataaatttcaattttctaagataatgaaagacagcctcttctgattgcctgaagtagaaaatccaactttcaagcaatcttccaattttcaccctttctcctaacctacctcatgttgccaattactgaaccctgcaaatgttccacagtgcacgtcactttgctgctcagctgtccatactgcctctttaggattttacttgttaaggccaattgacagttaccattatgctggtttttctttgcttaaaatacttttgctattatttccccttctaactctcagaagaaacagatgcaaatgtttgtgtttaaaacaatgtcttcaaactggaaattcatatttactaaaattacctgatttagctcttcaaaaatagagagcaatttatttatattattacatattttcagtaactctttaaactcctttataacatgtgtgcgattgaattccagttacctcagcatcatttattgaaaagggagtcctttccccattgcttgtttttgttagcctcgttgaagatcagatggttataggtgtgtggctttatttctgatttttctattctgttccattcgtttgtgtgtctatttttgtagcaacatcaagctattttggttaccgtggctttataatatgatgtaatgtcgagtaatgtgatgcttctggctttgttcttttggcttagcattgttttggttatttgggctcttttctagtgccttatgaattttaaaatcatttttttctaattccgtgtataatgacattggtagtttgataggaatagcaatgcaaattgctttaggcaccgtggccatttttatgatattgattcttccaatcaatgagcatggaatgttttttctatttatttgtgttacctctgatttctttcagcagcgtttcgtagttctccttgtagagatctttcacctccttggttagctgtattcctaggtatttcattttctttgagtccattgtaagtggaattgtgttcttgatttcactcttaactcttagcatagatgttgttggtgtatggaaatgctacttatttttacacatcgattttgtatcctgaaactttacttatattgattatcaattctaggagccttttggtagactctttagcattttgcaatagaatcatgtcattagcaaagagagtttgaattcttcttttcctatttggatatcttttatttcttgctcttgcctgattgctgtgtttagaatttctagtactatattgaataggagtggttagagtggacatccttgtcttattccagttctcaggaggagtgtttccagtttttgcccattctgtatggggttggctgtggatttgccatagatagctcttattattttgagatatgttcctttaatgcctagttttttgagggtatttaatattaagtgtttttgaattttatcaaaagtcctttttatgtcttttgagataatcatgtggtttttatttttatttctataataaatctcatttattaatttttatatattgcaacaacctagcattccaggaataaagctgctggattagctttttaatatgctactggttattttcgtctccctaggtgtgattttaggatgtcaatttcagatctctaactttttcacatgggtgttttccactataaccttccaaattaacatggcttagctgtgtcccaaagattttggtatgttgcatctttgttttcatttgtttcaaatattttttttcatttctgccttaatttaaattttccccaaagtcgttcaggagcaggttgtttaattagcatgtaattatatggttttgaaagagattcttggtataaatttctattttattgcgatgtggtttgggagtgtggttgatataatgggtttcttaaggacgtcttgcaaggctggtctggtggtaatgaattcccttggcatttgcaaatccgaaaaggattttatttccgcttcacttttgaagcttagtttggcaggatctgaaactcttggttggatttttttctttacaaatgctaaatatagattcccaatctcttctgggtggcagagtttctgctgaaaggtctgctgtagtctgatggggttccctttgtaagtgacctaacccttttctgtagctgctttaatatttttttcgttcacactgaccttgatgaatctgatgattatgcgttttggggatggttgtcttttccactgtctcacaggagttctctgaattgcctgaatttgaatgtcaacctctctagcaaggttggggaaatctctttgtagatcaaagaactatatggttaaaaaacacatatgggtgtggtggctcacgcctgtaatcccaggactttgggaggctgaagtgggtggatcacaaggtcaggagtttgagaccagcctggccagcatgctgaaaccccgtctctactaaaaatataaaaaattagccagtcatggtggcatgtgcctgtagtcccacctacttaggaggctgaggcaggagaattgcttgaatccagcaggtggaggttacagtgagctgagattgcaccactgaactctagactggacaacagagcgagactccatcttaaacaaacaaacaaacaaaaccaataaacaaacaaaagtctgtaaaagtagtagaagaaaatacaagtaaatatgtttataagcttgggtaaggaagaattttttttttttttgagacagcgtcttgctctgtctcctaggctgaagtccagtggcttgatcacagctcactgcagccttgaattccttggctcaagctatcatcccacctcagcctcctgcatagctaggactcaggcatgtgccatgctaagctaattttttatttatttttaaaattaattaattttttttttgagacggagtttcgctcttgttgcctagtctggagtgcaatggtgcaatctgggctcactgcaccctctgcctcccgggttcaagcgattcttctgcctcggtcttccgagtagctgagattacaggcatgtgccaccatgcccggctaattttgtatttttagtagagacagggtttctccgtgtcggtcaggctggtctcgaactctcgacctcaggtgatccacctgcctcagcttcccaaagtgctgggattacaggcgtgagccattgcactgctaagctaattttttttttttttttcctgaggcggagtctcgctgtgttgtctgggctggagtgcggtggcaggatctcagctcactgcaagctccgcttcctgggttcacgccattctcctgcctcagcttcccgagtagctgggactacagaagcctgccacaactcggctaatttttttgtatttttagtagagacaggctttcaccatgttggctaggatggtctcaatctcctgacttcgtgatccgcctgcctcggcctcccaaagtgctgggattacaggtataagcaactgcgcccggccctgctaagctaatttttaaaatgtttttgcaaatatgaggtctccctgtattgcccagtttggtctcaaactcctggcctcaagtggccttcctcatgtggcatcccaaagtgctgggattacaggtgtgagccaccacacctagtcccagaaagatattcttgaacaagaaataaatcacagccagatgcggtggctcacacctgtaatcccagcactttgggaggcctgaggctgatggatcacctgaggtcaggaatttaagaccagcctggccaacatggtgaaaacctgtctctactaaaatacaaaaattagcccggcatggtggccacgcctttaatcccagctactcaggaggctgaggcaggagaatggcttgaacccgggaggtggaggttgcaatgagccgagagcatgccattgcactccagcctgggcatcagagccagactccatctcaaaaaaaaaaaaaaagaaaagaaaaaaaacccagaaaacccaaatcagagagccattaagacaaaaaaaaaaaaaagactaataaatttgactccatcaaaaattaaaactcggccaggcgtggtggctcacgcctgtaatcccagcactttgagaggccgaggtgggtggatcatgagttcaggagttggagaacagcctggccaacatagtgaaaccctgtctctaccaaaaatacaaaaaaattagctgggcgtggtggcgggtgcctgtaatcccagctacttgggaggctgaggctggagaatcattggttgaactagggaggcagaggtttcagtgagccaagtcatgccattgcactccagcctgggcaacaagagcgaaactccatctcaaaaaaaaaatgcatatgtttcagctcagcaaccccacttctctattctcaaataatacacatatgtatgtttaaagaggtatgtacaagaatgttcactgtcaacactcttggtaatagcaaaaaaactggaaacaatcatcatttccatgaaaaaaagaatagctaaataaactatgcccacactatgctattctacataacagttaataatgaggatatgtatattgatatgaaaagatcaagatgtagttaaataaaaaaatgcaaccgggtgcagtggctcccacctataattccagcacttagggaggccaaggcaggaggctcacttgaggccaggagtttgagaccagcctgggcaacagagcatgaccccatctctacaaaaaatttttaaaaattagccaggtgtggtggtacatacctgtaggcggtggtaggattgcttgaagtaaggagttcaagattacagtgagctgtgatcacatatctctaaaaaaattttttttttaagatggagtctcgctctgtcgcccaggctgtagtgcaatggtgcaatcacagctcactgcagcctcaacttccctggctcaggtgatcctgccacctcagcctcctgagtaactgggactacaggtgagcaacaacacacccagctaatttatttatttatttatttatttatttatttatttatttatttaatttatttattttttgagaaggagtcttgctgtcacccaggctggattgcaatggcacacaatcttgacttactgcaaccaccacttcccaggttcaagcaattctcttgcctcagcctccttagtagctgggatgaaaagtgtatgccaccatgcctggctaatgtttgtatttttagtagagacggggtttcgccatgttggccaggctggtctcagactcctgacctcaggtgatccacctgccttggcctcccaaagtgccgggattacaggtgtgagctaccgcgcgtggcctgattttttgtatttttagtagagacagggttttgccatgttctcccaaagtactggaattacaggtgtgagccactgtgcttggcccctgtacaattttaaaatttaaaaaaaaattaaaaatacctggagttctggccttgaaaatcccatccttgtgggcgctccttccagtcttgaggagtgaacctggccatcagtgattctgaagaagcaatggccacagagaaccccagcacagcaaactgagaaactgccatttttgttgtattttattatttcctctagagatgggggggggggtctcaacatattgcccaggctggtcttgaactcctggactcaagcaatcctcctgcctcagcctcccatagtgctgtattacaggtgtgagcccccttgcctggcctggccatctatatttcttttgtttgtttgtttttcatttttgagacagagtcccactctgtcttccaggctggagtgcaatggtgtcatctcagcttactgcaacctctgcctcctgggctcaagccattctcctgcctcagcctcccaagtagctgggattacaggtgcccgacaccacgcccagctaatttttgtgtttttagtagagacggggtttcaccatattggccaggctggtcttgaactcctgacctcaggtgatccacccgtcctggcctcccagagtgctgggattacaggtgtaagccaccacactcggcctttttttcccaatgtttttttttttttttttttctcagagacctttgttctgagatctttatttcttctccctgttctttttccttgtctagtctacctcacaaatcatttcatgattaattttcctaaagcaaagggcaaatatttattaagcatttgccattatttgtactcagtatttggtaatggcaggaatgtttgaagaaagttaatatgatagtaatatggagcaatgtgaagttaagaagagagggagatggcaaccaatcaaaagactatatcaggccgggctttattcatcctgttcagaggtggtcacagcttcccaatgcctacaaaataaaggccaaattcctgagcctaatatccaagaccgtccattctatcctcaacatacctttctgatctcttcattacttcttcccattaaaagcctccaattcagccaattttttttttttttttgacatgggggtctcgctgtgtctcccagggtggaatgcatgacaccaccatagctcactgcagtctcaaaactcctgggctcatgtggtcctcagcttcctaagtagctgcaactacaggtgtgcaccaccacatgcagcttcagcctggctttcgcatgtgtgcgtacctctgttcacagttacttctcctgtctccttaaatcttgcttcctttatttattgattgattgaatgatttattgagacggagttttgctcttgttgcccaggctagagtgcagtggcgcaatctcagctcactgcaagctccgcctcctgggttcacgccattctcctgcctcagcctccccaggactacaggtgcctgccaccacacccagctaactttattgtatttttagtagagacggggtttcaccatcttggccatgctggtcttgaacccctgacctcgtgattcacccgcctcggcctcccaaagtgctgggattacaggcttgagcccctgtgcccgacaaggggtgcgtgttttttaaaacatgggagagggaattgtgcttcagaatcaccaccagctgttgcaacatcgggtgccactccatcccgcttctgaggcacgacggagcactttgggaggccgaggcgggtggattacctgaggtcaggagttcgagaccagcctgaccaaaatggtgaaacctggtctctactaaaaacacaaaaaattagccagacgtggtggcgcatgccagtaatgccatccatctacttgggaggctgaggcaggagaatcgcttgaaccccagaggcgaggttgtggtgagccgagatcgtgccattgcactccagcctgggaaacgagcgaaattccgtctcaggaaaaaaaaaattttttttaaaggaaaaaaaacccctctttttctagccggaaataccctctttcaggaaggcgcgcctgtgccgcatacgcacactcagttacttagcaaagtctgggctaaaccacccaaggcggagcccaggaacaacagagccaccgcatcccccaccaatcagcgccgacctcgccttcgcaggcctaaccaatcagtgctggtgctgcaagaaagtttccagagctttcgaggaaggtttctttaactcgaattcatccgcccaataattttcttatattttcctaaagaagagaagtgcatagaggagaagggacataatttgttaggatcctttcttacgctatgggaatttggggctcagttgaaaagcctgaactgcgtctggggatgttgggcgcggcgaactactttcagtggcgcacggagacggtgtctatgtaagaagtgataacgcaacacaccttgcacaaatttgcgctctgccaaaccagagcattcaggcacgactggctttgttgggtgaggttgttgtggtgttcctgtggctggacgtgattcgcagcatcctcgtatccgctaacaggtactggcccacagccgtaaagacctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggttcggttttgttttcagtttacctaacaccgtgcttaggtttgaggcaggttggagttcggtcaggggagtttgaatatccagaacaggtagtggagaaagttgtggacgcttggttagagagcgctctggattctccactgttgacattgaaaccttgagtgacgaattttgtattaagtgacttagcctcataaaaatcaggggaggtttgcggaatgttaccatgtttaaggcattttgaaggagtagttgctaactttgaagcatattagatgtaaaagcaagaaatacaatgatcctgagatgacacgcttatgttttacttttaatctaggtcaaaatgcggatcttcgtgaaaacccttaccggcaagatcatcacccttgaagtggagcccagtgccactatcgaaaatgtcaaagccaaaatccaagataaagaaggcaatccctgtgaccagcagaggctcatctttgcaggcaagcagcgggaagatggccgcagtctttctgactacaacatccagaaagagtcgaccctgcatctggtcctgcgtcggagaggtggtatgcagatcttcgtgaagaccctgaccggcaagaccatcaccctggaagtggagcccagtgacaccatcgaaaatgtgaaggccaagatccaagataaagaaggcatcccccccgaccagcagaggctcatctttgcaggcaagcagctggaagatggccgcagtctttctgactacaacatccagaaagagtcgaccctgcatctggtcctgcgtctgagaggtggtatgcagatcttcgtgaagaccctgaccggcaagaccatcaccctggaagtggagcccagtgacaccatcgaaaatgtgaaggccaagatccaagataaagaaggcatccccccgatcagcagaggctcatctttgcaggcaagcagctggaagatggcggtactctttctgactacaacatccagaaggagtcgaccctgcacctggtcctgcgtctgagaggtggtatgaagatcttcgtgaagaccctgactggaaagaccatcaccctggaggtggagcccagtgacaccatcgaaaatgtgaaagccaagatccaggatgaagaaggcatcccccccgatcagcagaggctcatctttgcaggcaagaagttggaagatggccgcactctttctgactacagcatccagaaagagtcgaccctgcacctggtcctgcgcctgaggggtggctgttaattcttcagtcttgcattagcagtgcccactgatggcattactctgcactatagccatttgccccaacttaggtttagaaattacaagtttcagtaatagctgaacctgttcaaaatgttaataaaggtttcgttgaatggtagcatacttggtgttttgtcatgatattctctagtgatgtgtgggtacacttaaaactggtgaaaatgtctagggagggatttaattttgagattggtaatgtgcccaaagttaagtcacttgactctggtatacacttgggtgggctgaggggtaagagccttctttgctgtaagtcattacaagttaggatcctggactaatggcaaactttctgaagctcgaatttaaagtctgttgggagtccgaggtgggcggatcacgaggtcaagagatcaagaccctcctggccaacatagtgaaatcctctctctactaaaaaaaattagctggatgtgatgtcgcctgcctgtagtcccagctactcaggaggctgaggcaggagaatcagttgaacctgggaggcagaggttgcaatgagctgagatggtgccactgcaccccagcctggtgacagagcaagactccatctcaaaaagttggatatgcaggcttttttaaagatggtcttgctctgtagtccagactggtatacagtggcacaatgacagctcaccgtatcattcttgggctcaagtgactgcagggattttctttacaaatatgcctgcctaggcctaatcaaagattgctggagaaatagttttgattgaggctgcctgaatagtggtaacgtaactgctttcaattctgcaattattgggtgactatgagctgtgtgtttattgctctgtagtgtagtaacaccgaagtgtttaacctgggtggtagtatgggaccgtaatcttgtctgtttgctgtatatgttttaaatgatgagccaagaagcagctaattactgagtatggaagactactggctgaggagaaagatggcttgcaggtacttaatgtttaaaactgtatcctgatctaagacaatcttcctggtcttgatgagttaggtggcaaattaaagtggttcctcacacagttggtttttgtttttgtttttgttttttttgagacagagtctcactcttttgccccaggctggaatgcagtggtgcgatctcagctcactgcaaactccgcctcccaggttgaagcaagtctcctgcctcagccccccacgtagctgggactacaggggcccaccagctaatttttgtattttcagtagagatggggttttaccatattgaccaagctggtctcaaaagtcctggcctcaagtgatccacccaccttggcctcccaaagtgctgggattacaggcatgagccaccactccgggccacgctgttgtttcttaatgtctaacagcttaactttattgtgaaagactgcagcaacaaatgagattttatctgtatttggtaaaaatgcttatccttgtctaagtctggcaacataagcagtttttaggcttctatcccaatggacattaggcagtaatacatgcgcagtgctaatagaaaatatttgagggagtaagggtgtactaaggaagttctcaaatcttcctgcttcactatcttctgtaatacaacttcagtaaatgtgattctcatcttggcacaaaattgggagtagtgtggggagccctgtttaattttttttttcaggtttatagtagggaaataatgttttctggtactaaaactggcgtggtaagtgcatacttagggtaaggactttaaatcactggccagttaatctctagttggtggtttagcatgcaagaagtacccatgggtatattacacaaatgcgggaatagcatatctagaaataagcctttgatattcatagtgtacctgagaatggtttcacacataattttaggtaatctgccttagtcactctggttttacggatctttgcccacagttcctggttcataacttctatagcccttgttatagtcatgttgggtgtgttaggccacaggaaactcacttaacttctgcccttttaccttccctaagacaggactcataatcttcccctacctttctgagtcctgagacccccatttcagagagggttctgtcctgtaccctggggaaaggaatgctgtcatcgtgaagcctccttagaaaaccaagaggactgagtttggatatctgaacacatggaggttcctggaggatggcacacccaagtaaggcattaaagctttgcaccccttcccccataccttgtcctatgcatctcttcatctgagtcctttgtaatatctttataataaaccagtaaacgtggccaggcgtggtggcttatgcctataatcccagcactttgggaggtggaggtgggtggatcacttgaggctagagcttgaggccagactgggcaatgggctctttacaaaaaaaaaaaaattaaaatgggcatggtggcatatacctgtagtcctagctacttgggaagctgaggtggaaggattgcttgagtccaggagttccaggccagcctagcacagcaagatcttgtcactaaaaacctagctcttcaaacctggaaaattaaaacgtttcactgaatacctaaaaactattatctggggcaatagggcttaaaatattgtgctgtcatttctcccaaagtgtcactgtctgacaatataggctcataggtctgtagtctggtgaatccttcagaagaagattcagctgttgctctttagttctcttttggaatattttattttccatagagatccccctctaagtaattcatggatctcagcaaattcactctgcacacaaatgaatctgagcaattttgagacagagtcttgctctgtagcctaagccagactgcagtggcacaatcttggctcactgcaacctctgcctcccaggttcaagcgattcttgggcctcagcctcctgagtagctgggattacaagagtggtcaccacacccagctaatttttgtatttttagtagagacggagtttcaccatgttggccaggctagtcttgaactcctgacttcaggcgatctgcccgccttggcctcccgaagtgctgggatcacaggcgtgagccactgcacctggccagggaaaggctctttaaatatgtgttggaggcctggtctatggcctgatgccagtccaaaatagttcttgtcagctctcagttaaataaaaatgagaacagcggccaggtgcaaaggctcacgcctgtaatcccagcactttgggaggacggggtggggggcggggtgcggatcatgaggccaggagttcgagaccagcctgaccaacatggcgaaaccccgtctctactaaaaatacaaaaaattagctgggtgtggtgtcacgcacctgtaatcccagctacccaggagggtgaggcaggagaattgcttgaacccaggaggcggagattgcagtgagctgatatggcgccactgcactccagccttggcaacagagtgagacttcatctcaaaaaaaaaaaaaaaaaaaaagaacagctcagtggattttacataaaaaatgtattcaacttaaaagacatgtcctctgtaaaaatgttgtggtctaatggtttagtgtgactctggatacaagacttcttgagtcaaatctggctgcttactagcttgtaacgttgggcaactaatcctgtcagtacatcaaattcctcatctataaaaattgggttaattacacctgtctcagactagttataattacctgtgaagcacttaaaacaatgtaaaaacttggccaggtgaggtggctcatgcctgaagtcgcaactacttgggaaacaagcagaatggcttgagcccaggaattcagggctgcagtgagttaccaggtaatgccactgcactgcactccagcctgggcaacagaatgaaaccctgtctctaaaaacaaaacaaaaccaaaaaccccacacacttgcgtagtgcttaatatgctattttttgtaataaaattaccaatcaagatgagatgataggctgggtgctgtggctcacacctgtgtaatctcagcactttaggagcccaaggtgggaggatcgcttgaacctggtagtttgagatcagcctgggcaacatagtaagaactcatctctacaaaaaatgaaataaaaggcgggaggatcactgcaatgaggttaacgctgcaatgagctgtgatcttgccactgcactccagcctaggtgatgggagtgagaacctatctcaaaaaaaaaaaaaagatgataatgcaataagtaaactgaatgaaggtgataggaacttcgtggggcaatatccaatagaggaaaaaatgctataggaaaaaatatgcctaagcacaaagacaggtgggccactgttaacaatggttgcttcaggagaatagaggagtagttttaaagggaggtatatttcagctcctctctagatattcttaaatctggcacccacataacatcagcattgtccacaagcactccatgtttaagagccagcaatataacagccctgaagtcagactgtgtttctggatagagtagacattttgcacaaatctctggttcaatctctatcactcctatagggcctctagaaactttatctcatgagacttcctgaaccgcgacacacttcattttagctacactttattcattcttcaaagaatctgagcaggcaagccatgactctattttaatcaggcccagctaactctaaatggaagctttagatacatgttgggttctgggaaaggatcttgtacttagcgcagcaataattatttagtatatgagcacttagtttccttagtctgacaataagtacttagtttcctcagtgcaacaaggaagtaggttttgaggtttttccttttttcatacttttttcttatcttttttttttttttttttttttttttgaggcagagcctctctctgtcacccaggctggagtgcagtggcatgatctcggttcactgcaacctccacctcatggattcaagctattttcctgcctcagcctcccaagtagctgagttttatactttcttaatctcccacttttttttttttttttgagacggagtcttgctcttgtcgcccaggctggagtgcagtggtgcgatctcagctcactgtaacttccgcctcccaggttcaagtgattctcctgtctcagcctcctatgtagctgggattaccggtgcccacagccacgcccagctaatttctgtatttttagtagaaacagggtttcatcatgttggtcaggctggtgtcgaactcctgacctccgctgatttgccaacctcggcctcccaaagtgttgggattacaagcgtgagccaccgcgcccagctgatctcccacttttttttttcttttttcttttttgagaaagagtttcactcttgttgcccaggctggagtgcaatggcacgatcttgccttactgcaacctccacctcccaggttcaagtgattctcctgtctcagcctcctgagtagctgggattacaggcaggcaccaccatgcccagctaattttgtatttttagcagagacagggtttcaccatgttggtcaggctggtctcaaactcctgacctcaggtgatccgcccgcctcagcctcccaaagtgctgggattataggcatgagccaccgtgcctggcctcccactttttttaatcatcaaatgttgggtggtgaagttcactctccgccagtaggtcccagacagctcctataaaattctaaaacctattctaaccacacaacactaaccagggccccttttaagaaacactattatcttcagaaatttctgatatcagtgtttccccaaactatcttccaaacattacaaccagtacgaaaaacgatgctgtgatcacaaggagttatccattatctccctcctgaagacctacaatgtcctacaattgtacattagcatatttaagtctctaaggagttctaccttataggaactggtttaacattgtttaacccagtgttttccaattttcaatttcacttatgtttcactttttttttttttttttgaaatggcattttgctcttgttacccaggctggagtccagtggtgccatcttggcttacggcaacctccacctcccaggttcaacagtgattctcctgcttcagcctcccaagtaactgggattacaggcatgagccaccacgcctagctaattttgtatttttagtagagatggggtttctccttgttggtcaggctggtcttgaactcccgatctaaggtgatccacccacctcagcctcccaaagtgctgggattacaggcgtgagccactgcacccggcctcacctttttttggtgggggagacaaagtcttggtctgtcacccaaattgaagtacagtggtgtgatctcgcctcactgcaacctctgcctcccaggttcaagagattctcctgcgtcaccctcctgagtagctgggattacaggcatgtgtcactatgcctggctaatttttgtatttttagtagagacagggtttcaccagtttggccaggctggtcttgaattcctggcctcgaatgatccacccactttgacctctcgaaatgttgggattacaggtgtgagccattgcgtctggcaatcatttttttttctttgtccccaaggccggagtgcagtggcgtgttctcagctcaccgcaacctccacctcccaggttcatgtgattctaacaggaggtgacatattattattaatgaatgataatagttaactcttatttacgcttaccatgcaataggcattattctaaggttttacatgaactggcttatttgattttcacaactatccacccacttaggcacacagagctggggtttgagcccagacaggctggctccagagttcttgctcttaatgcttcgagataagatctcctgagagaataagcagaagtcagtcacataaggatctggaaaacaacattccagaaaatggactaagcaaggctcaagtttctgaggctagccagcactgagatatttagagatccacctacctcagcctcccaggtagctgggactacaggtgtgcaccaccacgcccagttaatttttgtatttttagtagagatagggtttcaccatgttggctaggatggtctcaatctcttgaccttgtgatctgcccaccttgcctcccaaagtgctgggattacaggtgtgagccactgcacctggccatcactttctttttcaatgacataacatttctcataatttgagaaacagtgttcaagccatgccctgtctcctgtctccgtatctagtactgctgattgtgcttggttctaggcgtctttcgatgatagaaacatgctgctgtgaattcgaggcaggctgcacactgggcttggatcttctacttttaaaatagaacaatacaggctgggtgtggtggttcacgcctgtaatcccagcactttgggaggatgaggtaggtggatcatctgaggtcaggagttcactatcagcctggccaacatggtgaaaccccgtctgtactaaaaatacaaaaattagctgggcatggcactgggcacctgtaatcccagctactcaggaggctgaggcaggggaatcactggaactcgggtggcagtgagatcccgccactgcactccagcctgggtgacagagtgagactctgtctcaaaagaaaggaaaagaaaagaaaaaagcatgaaaaaaggaaaagcaagactccgtctcaaaaaaactagaacaattcaaatattgagggggacgaagacttggtctgttgcccaagctgaagtacagtggttcaatctcggctcactgcaacctccacctgccaggttctgaggcggaaaatgaacgaaaaataaaatttagaagaaagagaaataagttttcctatattaggctgacttgtgcagcaacgggcacagcccagacccaggaaaagtcttgataatattatctaatgtgctctggagattctcccagcactccctcaacattgggagaagaaaaacaaattttcctttgttttatggaatgagtttatagattcttgttctctgtaactaatgacttcaagtattctgttttatctaagaagtacaacgaaggtcacaagaagcctgagtaggcctgaactacagctgcctgagcaccatagtgaaggttataggataagcctgtgccctgacaaacctagataacagacatctgggttgcttggcaacagtcatgtgcaatcctgtctttgtcctgcctctgtatccctgatttcatgccactgtaaccttgcttcaagctagcccacccccttttctgaagtgtgtataaaagtcaggtgctgtctttattccgggcccagtcttttacacgtgagtcagccgggcctgagtgcactcaatattctcctgtttcaacccgaggtctctctcgtcctcctgaatcccgcaacagttcaagcaattctcctgcctcagccttctgagtggctgggaccagaattgtgtgtgccataggtgtgtgccactatgctcagctaatttttgtatttttagtagagacagggtttcaccatgttagtcaggctggtcttgaactcctgacctcaggtgatccatctaccttggcctcccaaagtgctgggattacaggtgtgaggcactgcacccggccaattttttgtatttttagtagagatggggtttcactgtgttagccaggatggtctcaatatcctgacctcatgatctgcctgccttggcatcccaaagtgctgggattacaggcgtgagccatcatgcccggtttatagattatcttaatcagttgctactttgctgcagcttgtctttaagcatatgttaccagaaaaattaacagacaaatttcgacatggaatttttttttttttttgagacagagtcccactctgtcgcccaggatagagtgtagtggcatgatctcagctcattgccacctctgcctcccaagttcaacggattttcctgcttcagcctcctgaatagctgggatacaggcgcacaccaccacacccggctaatttttgtatttttagtagagatggggtttcaccatgttggccaggatggcctcgatctcaaggtgggtgatccacccaccttggcctcccaaagtgctgggattacaggcatgagccaccatgcctggcacacacctggctaatttttgtattttttagtgtagacggggtttcaccatattggccaggctggtcttgaactgttgacctcgtgatccgcccacctcggcctcccaaagtgctgggattacaggagtgaaccaccgtaccaggcctggacatggaattttaaaaaattatctaattcgttgctttcttctgagagagagtctcactctatcgcccaggctggagtgcaatggtgcaatcttggctcattgcaacctctgccctttttttgaggcagagtctcactctttgcccaggctgtagtgcagtggcatgatctcggctcactgcaacctctgcttccaagggtcaagtaattctcatgccttagcctctggagtagctgggattacaggtgtgcaccgccacacccacctaattttttttttttttttttgagatagagtctcactctgtcgcccaggctggagtgtggtggcatgatctcagctcactgtaacctccacctcctgggttcagtgattctcttacctcaccctcccaagtagctgggattacaggcgcacaacaccatgcccagctaattttttgtacttttagtagagatggggtttcaccatgatgcccaagctggtttcaagctcctgacctcaagcaatccacctgcctcagcctctcaaagtgctaggattacaggcatgagccaccgcaccctgcctaatttttgtatttttagttgagacagggtttcaccatgtttggtcaggctggtctcaaactcctgacctcaggtgattagcacctctcttacaggcctgagccaccctgcccggccctagtttagttttgttttttcaaaacagggtctcactctgttgcccaggttggagtgcactggcctaatctccgctcattgcaaactctacctcccgggttcaagcgactcttctgccttagcttcccaagtagctgggattattggtgcccccagccatgctctgcttttcatattttttagtagagatgggttttcaccatgttggccaggctggtctcaaactcttgacctcaagtgttctgccccccgaagtgctgcatttacaggcatgagccacggtgaccagcctgattggttttgtaaaatacaaaagtgatacaagctcttgataaaaatacattcagtggcatataagagtatccagtaggctgggtgcgtggctcacacctgtaatcccagcactttgggagtccaaggcgggcagatcacttgaggtcaggaattcaagaccagcctggccaacatggtgaaacactgtctctactgaaaatacaaaaattagccaggcgtggtggtgcacgcccatagtcccagctactagggagactgaggtaggagaatagcttgaacctgggaagcggaggttgcagtgagccaagatctcgccattgcattccagcctggctgtcgcaaaaaaaaaaaaaaaaaaaaaagtatccagtaaaaactcccctctcacctttccttgtatccccagaagaaaccgtttaatgagagtatatgttttcatttatttattcattcaacaaatattaggtgtttgctgttttttaaaaaaatgtaatttaagtttttagagtcagggtctcactctgtggccctgcctggagtgcagtgacacaatcatagcttactacagccttaaactcccgggctgaagcgatcctcacaccttagccacccgagtagctaggactacaggcacctgccaccacaccaggctaattaaaaaacttcttcttcttcttttttttttttttgagatggagtcttgctctgccgtccaggctggagtgcagtggcgccgtctcggctcactgcaacctccgcctccctgcctcagccttcggagtagctgggattacagacgtccgccatcatgcccggctaattttgtgtatttttagtagagacggggtgtcgccaccttggccaggctggtcttgaactcctgacctcaggtgatccacccatctcggcctcccaaagtgctgagattacaggagtgagccacggcgctgggcttttttttttttttctttttagacggagtcttgctctgttgcccaggctggagtgccttggtgctatctcagctcactgcaaactccgcctcccaggttcatgccattctccggcctcagcctcccaagtagctgggactacaggcgcccaccaccacgcccggctaatttttttgtatttttagtagagacgggggtttcaccgtgttagccaggatggtctcgatcttctgacttcgtgatccgcccgcctcagcctcccaaagtagtgggattacaggcgtgagccacagagcccagccgacgcctttttttttctttcttttaaagagatggagtctcaccgagcactgtggctcacgtctgtaatccccaggactttgggaggccgaggcgaggggatcgcttgagcccaggagtcgagaccagcctggacgacatagcgagacttcgtttctgaaaaaaatgcaagcattttgaacccgggaggcggaggttgcagtgagccgagatcgtgccgctgcactccagcctgggcgacagagcgagactccgtctcaaaaaacaaaacaaacaaacaaacaaaaaaacaagcaaacaaacaaaaaaaaaaaccaagcatttggcaggcatggtagcgcacgcctgtggtcccagccagccactctggaggctgaggtgggaggatcgcttgagccagggagttcgaggctgcagtgagcggtgatcgtgccactgcactccagcctggaggacagaggcagaacttgtctcaaaaaaaacaaaaaacaaaaaaccggccagtgtgtgaggggcgcgcgatttttaagatgtgagagagggaattgtgcgtcaccatcaccaccaggtgtcgcgacatcgggtgccgcgccgtcccgcttctgaggcgcggtggcctgagaaactggcttcagagcccgctcttcctagccttctgcccgaaaatgcagaatttggggaattggaactttggaggcgggagcgaaagacctctccttctctcgccggaaatatccctctttcgggaagcgctcccctgccttccggaaaggaagagccctgatcgcgcccctgcactcaagcctctgggtgatagagcgaggagaccctgtctccaaaacacaaacaaacaaaaggtaatggggggggggggggcaggcgcggtggctcacgcctataatcccagcactttaggaggccgaggcgggtggatcacctgaggtcaggcgttccagaccagcttggccaacatggtgaaacccccgtctctgctaaaaataccaaaaaaatagctgggggtggtggcaggcacctgtaatcccagctactcaggaggctgaggcaggagaatcacttgaacccgggaggcggaggttgcagtgggctatcacaccgttgcactccagcctgggcgacaagaatgaaactctgtctcaaaaaaaaaaaaaaaggtagtaggaacattgctggtaattgctgtgtgagcacactaataccacatttatacctgtctttctgaacttctatgacaatgtaaacatgcatatgtatatagatatctccatatatagttactctcaccttgttcacagctgctcttacactagatatacaattttctccttcaaataatgttaatgctaactatgaatgtaatatatgctcagtgtatgaaatttaggaaatatagaaaaagaaagcactcattatccctacgatccaagtatattcagtttggcatgtttcctcttttcccagtattaattttttacttaaataacaatgaatacaatacaagttgtaaggacttgaccagcagatatacagagagtgagtaaaaacattgaagtcctttttcagcgtcccttcccagatgtcctcttcccacacatctttttctgtgccacttgctagaagtttggtgtatttacgaccagattgttttcaatgtgtcacatatgtttgtgttatataaaaacatactttaaaaatcatatataaatgcaattatgcattacacacccatctttcttggagacatttccatgctaacacatatagatgtgccttattcttctcaaactgctgcaaaatatttcatggtatagatacaccatattttacccttctccttactgatggtatttatattgtttctaatttttactattaaaacaatactgcaattaatatctttgtaaatgtctcttgtcacaaatgtgcaagtatttcttcaggatatactagaagtagaattgctgtatcaaagattatggcatttaaaaattggggattattacagaattacccatcaacagactgtacaacaatggaatattattcagccttaaaaggaagaaaattcggctgggcacggtggctcaggcctgtaatcccagcactttgggaggccgaggcggacggatcacgagatcaacagatggagaccatcctggctaacatggtgaaatcccgtctctactaaaaatagaaaaaatagctgggcgtggtggtgcacacctgtagttccactcagctacactggaggctgaggcaggagaatcgcttgaacccaggaagcggaggttgcagtgagccgagatcagggcactgcactccagcctggagacagagtgagactctgtctcaaaaaaaaaaaaaaattctgctgggcacagtggctcatgccagtaatcccaacactttgggaggccaaggtgggaggatcactcgaggcccggagttccagaccagcctggccaatatggtgaaaccctgtctctactaaaaatgcaaaaattagctgggtgtggtggcgcatgcctgtaatcccagttactcgggaggctgaggtaggagaatcacttgaacccgagaggtggaagttgcagtgagccaagattgagccactagtggcactctagcttgggcgacagagtgagactccatctcaaaaaaaaaaaaaaaaaaagagaccagccttgctaacatggtgaaacgcatctctactacaaatacaaaaattagctgggcgttgtagcaggtgcctgtaatcccagctactctagaagctgaggcaggagaatctcttgaacccgggaggcggaggttgcagtgagccgagatcgtgccattgcactccagcctgagcaacaaaatcgaacctctgtctcaaaaaaaaaaaaaatggaacttctgacacatattaccacatggatgaatcttaaagacattacactaaatgaaacaagacagacacaaaaggacatatactgtgtgattccactatatgaggtagctagagtagtcaaactcatagagacataaagtagaatggtgggtgccaggggctgggaaaggagggaatggggagttagtgtttaatggggacagagtttcagttttgcaagatgaaaaaagttctggagatggatggtggtgatggtcacacacaatgaatattaatgctacgaaactgtacacttaaaaatggcttaaacggtacattttttggtatttatagttgatcacaatttttaaaaagactgtaccaatatcaattcccaccagtattgcataagagagagtatctagtcctccaccacttcattaatattatacattatgaataatttcaactttgaacatattgaggggcaaaaacaacacttgattgttttaatttgcatgtgcccaattacttctgagattggataccttttgaatgtttacttaacattaatttgtcttgcaaattatctgttcatttcctttgcccaattttagtatgaatttgttcgactatatattctaacaactaataatttatttaattgtggtaaatattgtctttcagacttgcttcactttttttttttttttttttgagacagtgtctcactctgttgtccaggctggagtgcagtggtgtgatctcagctcactgcagccttcacctcctgggttcaagactcccaagtagctgagcttacaggcacacgccaccacacccggctaatttttgtatttttagtagagacaggatttcaccatgttggtcaggctggtctcgaactcctggcctcaagggatccgccttcctcagcctcccaaagtgctggaattacaggcatgagccactgcacctggccttacttcacttttcaattatggtgtcttttgtaaaaaagaagtttttaattaaaaaaaaaaagctcccatctctccaaaaataaaaaattagctgggcatggtagctcacacctgtggtcccagctattcgggagactgaggtgggaggattacttgagccgagggggtcgaggctgcagtgagctgtgatctccccactgctctccagcctgggcgacagagcaagaccctgtctcaatcatcatcatcatcatcatctgacaatctttttccttatggcttctgggccaaaggaataaatgaaggtataaggcttgttgataactattaataacacacattaaaaaaaaactatgcataacacacatttgaaatctacagcacattgcctgaagttagcatgttgggttctggctctgtctcttgcttcaacagtgtttagaacgaacagaccagggggatccctcttccagcctgtgatcgcctcccatctccttttcacttgagcctcccagaccatcttcttggcaacctcctgcttctgggcccagccaacaccgtttttgtggatatcttcttcttgtccccaagcatgagctcctagatgtgttagaatgattccacccaggcagaggcagccaccaactgccccgtcaaccggcatctctctggacttctactttggccacgatgacatggctctggaaggtgaactggccaagcatctctggaagatgcaaagccagcgtggcagcctgctcttttgcaggacctgcagatgagatgaatgggataaaaccctggacgccgtgggggtagccctggccctggagaggagcctgaacctgggttctgctgacacagacgtcacctctgggacttcctagagaggcctttcctagatgggggagtgaaactcgtcaagagggtggatgatcacctgacctctgcgggctggccacctggagccgggccaggcaactgtcttttccaaagtctggccaccctcaagcatgactgggagcctagcgagcccagtgacctctgagaggctcctctcaaaggatcagggtttctgcctgcctgagcctccccctccagccactaggcagctttttaaccctggagccctctcccaagcctggatcaaatttgcagggacaaaacgggggcaggggctggggtggggaaatcaaattaatgaccttcttagggtaaggatgttccaggaagaggaaacctgccatcccacaacccctagaccataatagcaattattccctccagggatcaacaaaccagtgacagactctagaaccattgaaatctactgattaaggccaggcgccgtggctcccacctgtaatcccagcactttgggaggccaaggtgggaggatcacgaggtcaggagctcgagaccagcctggacaaaatagcaaaaccccgtttctattaaaaatacaaaaaaaatttagctaggcgtggtggcgggttcctgtaatcccagctactcaggaggctgaggcaggagaaccacttgaacctgggaggcagagattgcagtgagccaagattgtgccattgtactccagcctgggtgacaagagcaagactccatctcaaaaaaaaaaaaagaaaaagaaaactctactgattaatgcctatcttaactccagtgtcagtagtagctttgacaaaggccttttatatcacatggctatactttgccaagcatactgaacactattataattgtttcctaataccccatgtgatacccacatgcttcttcataagtttgtaacacatttaaaaatagcatgacgccaggggtggtggctcatgcctgtaatcccagcactttgggaggctgaggcaggttgatcgcctgaggtcaggaattcaagaccagcctggccaacatagtgaaaccctgtctctactaaaaatgcaaagaattagctgggcatgggctgggcgtggtggctcacacctgtaatcccagcactttgggaggctgaggtgggcggatcacctgagattgggagttcgagacctgcctgaccaacatggagaaaccccgtctctactaaaaatacaaaattagccaggtgtggtggcccatgcctgtaaccccagctaattgggaggctgaggccagagaatcacttgaacccgggaggcagaggttgcggtgaaccaagatcgcatcaatgcaccccagcctaggtgacaagagcaaaactccgtctcaaaaaaaatttaaaaaaatgaattagctgggtgtggtgggcgggagcctgtaatcccagctactagggaggctgaggcaggagaattgcttgaacccaggaggcggaggttgtggtgagccaagatcacgccattgcactccagcctggacaacaaaagcaaatctctctctctcaaaaaaaaaaaaaatcagataatctagaatggtaaaaagaagagagtaaaattacctaaataaattaccaaattcccatcatctggaggtaactattcatagcacagatttttaaaaaatgggttatcatataatgctttctattttttatcctgcttttttaaacttaatttttctacttacattgttttatgctaataaatatatatcttcattgaaataactgcatagctttctgttgtatatatcataatttatttaactcatactaatggggcatttgtaaacaaatctatgatagaaatgcatctcttcatatatatatgtgtgtgtgtttgtgtgtgtgtgtgtgtgtgtgtgtgtgtgtgtatttagagataggctcccactctgctgcccaggcttgtgtgcagtggtgcaatcatagctaactgtaaccttgaattccggtgtcaagtgatcttcccatctcagcctcctgagtagctgggaccacaggcaggtgccaccatgcctggctaatttatttttatttttatttttttgtagagctggggtctcaccatattgcccaggctggtctcaaactcgtggcctcaagtgatcctcctacctcagcctcctaaatcattgggatttagaggcatgagccactgtgcccagtctcttgacatattttgtaaataaaaaacaaggaagaaatatttataacacaggcgtgtgccaccatgcccagctaattttttgtacttttagtagagacagggtttcacaatattggccaggctggtctcaaactcctgacctcaagtgatccgcccaccttggcctcccaaagtgctggcattacaagcatgaggcattgcgcctgaccttaaaggactaatttctttcttttttttcttttcttttgagacaggatcttactctgtcacccagactggagtgctgtgataaaatcacagctcattgcagtctccatgtcccaggcgcaagtgatccacatcagcttcccaagtagctgggactacaggggcacatactacacctggctaatttaaaaaactctttgtagagacaggttcttgccatgtttcccagactggtcttgaactgctgacctcaagcgatctttctgcctcagactctgaaagtgctgagattacaggcatgggccactgcacccactgaaaggactaatttcttcaatatgtaagtggtttctataaatatatgagaaacagattaataacacaataggaaaatggacataggacaggagcaaacaattcacagaaaagaaaattgttcctttttttcttttgagatggagtcttgctctgtcacccatgctggagtgcagtggtggcactatctcggctcactgcaagctccgcctccggggttcacgccattctcctgcctcagcctcccaagtagctgggactataggtgccggccaccacgcccggctaattttgttttttgtatttttagtagagacgaggtttcaccgtgttaaccaggatggtcttgatctcctgacctcgtgatccgcccccctcagcatcccaaagtgctgggattacaggtgtgagccaccatgcccggccaaaaattgttcttaaacacatgacaagatgtgcagcttcacttagcataagaaaaatgaccattcaatgtatgaagtggcattttttaatatttcagattgacaaagataaaacaagactgttaatacttttgtttacaagagtgcagagaaatgcatcctcatgcattgttggtcagtgtaaactggtacaacctctttggaaggcagttgggtaagtagctatgaaaatctcaaatgcagctgggtgaggtgcctgtcatcccagcactttgggagactgaggcgggtggatcacctgaggtcaggagtttgagatcagcctggctaacatagtgaaaccctgtctctactaaaaatacaaaaaaaaaaaaaaaaaattagccaggcatggtggcaggcacctgtaatcccagctacttggaggctgaggcatggagaattgcttaaatccaggaggcagaggtttcagttagccgaggtggcaccactgcactccagtctgggcaacagagtgagactccatctcaaaaaacaaacaaacaaacaaacaaaataaaatctcaagtgcacgtaccgtttgtgccagtaattccacaaccgggaattttacagatactctcacagatgtgaaaaaagaagtatgcgcacagatgttccctgcagtatcgttaataatagaaatacactcaaggccgggcgcggtggctcacgcctgtaattacagtactttgggaggccgagatgggtggatcacttgagggcaggagttggagagcagtctggctaacatggtgaaacccagtctctactaaagatacaaaaattagccaggcgtggcatcacacccctgtagtcccagctactcaggaggctgagttgggagaatcacctcaacctgggaggaggaggttgcagtgagccgagatcacaccattgcactccagcctgggtggcagagagagaccccatctcaaaataaataaaatacaataaaataaaataagaaaggtgaacattagcagcagcaaggcagccatcacctttgctctgtgaagcctgtggtagggatggatatgaattagctgtggtgggagggactgagtaagctctgggaccatgtggctctgctggacacagcaggggaaggcagtggtccaggcttcccaaaaaccagccttgaggaataaagataatgctccgaattttcagaactgctctgctcactctgagtcagagtggaaaatactgactgctgcatctagcaaaggagatgtttcagcactgttttgggaagaagggcctgtagggcttatctgacgagggccttactgtcatctccgcatcatgccaagcagcctttccttagacccagggctcccacccccactttcagattagctgccagcctccaacactctgctgttttcctttcctgagaagcagcccctgtgaaagctgtttttctgagcatcaggcctgagcataatctgctttagcagctgaagtggtctgctcttcttttactgaaagcactttaatacagaaattctgttgaccttttagatttatatatgcttctccctcccctctgggcttttcctggaagtaggttggcaaggtttactggaacagtatggttcctacccccacaccagccaagaccttgagaagagagaaggtgctgagccactcaagcacatggccaggggagcttagaaaaacagggacttccaacctgcctgggcaatatagtgagaccccattctccaaaaacaaggaaaaaagaaaaaagaaaaagagggaccctccaaacacaagcagggagaagctgaagaagtgggtgctagaagagcctggagatgtgtagatggcagcctgtctgctgctctgggccttggccattgcctgtgctgctgatgcttctgccgtctcttcttctttcacaaaactacaagagctcaggttgcggctgctcaaaagcttcccgcaatgtgctgattcactctaagtgtctgctcctctgcagactgacttcatgcacttaaaataattcactcatttcattgttagctctgtcctctccacttgcatttcaggccagagcagtacaatgaggtcccaagctctgtcctgtaaaccacagataaaattctaaggcccctccacaaccatctgaatgggcccctcttcttggctaaggacattcccaaggaaatctgaaaatctagttcaggacatgacggaagagcaggtcacacaagcatcattataacctcctcccttttggaattcaggaaaagccaaccagcattaacatcaacacagatcttaagtctggtaagaaacatttacaatctattttctctgaagtttgctacctggaagcttcatctgcctgataaaaccttggtctcaacaactgcttatcataacccagacattcctttctactgataataactctttcttcttcttttttttttcctagacagagtctcgctctgtggcccagactggagtgcagtggccccatctcagctcaccacaacctctgcctcccgggttcaagtgattcccctgcctcagcctgctgagtagctgggattacaggcatgcacaaccacaaccagccaattttgtatttttagtagacacggggtttctccatgttggccaagctggtctcgaactcctgacctcaggtcatccacccgcctccgcctcccaaagtgctgggattacaggcgtgagccatggcccctaaacaactctttcaaccaattgccaatcagaaaaaatttaaaatctgcatgtgacctggatacactccccacaagaacttcaagttgtcctgcccttccatatggaaccaatgtaagtcctatatgtatttgactgatgtctcatgtctccctaaaatatataaaactaggctgtgtcttagcaccttgggcacctgctctcaggatctcctgagggctgtgtcatgggccactgatcactcatatttggctcagaataaatctcctcaaatacatttttgccaacagtccactgggctcaggtgagcagggcctgaaacagataacatggaaatttataataaaataagggacccatgccttaagacataccacaaagtaaatataacactgtacaggctctctcgggtgaccctggactacagaatgtgggttgtggggagggagagacgtggactttttcctgcaggtcatggcttgggtgcacctagaaacaggccaataccaccccttcttttctggaaaggtggggcctgacagctttgcgtggggaaccagtgtcctgttacagttcaggtctaaaatgcctgctgagtaaataaacatgttgttctcaacctaacccaaaaagcctgatatttgtaggaataaaattgctctttcctaccctgggcaaactgcttccctgacaaatatgctcagtcatggagtggagacagataagtaaagagatgctgggaatagagcagagacagataagtaaacagatgctggggatatgtcatgatacagagccaggccagagtcaagcaaggtgttgcattggcatactgccggcctttcctgcaggaaaaggtgtgaaaaagctcttgaggtgatgggaaggggtgtgctgttttgaaatgggaagataaaaacagagccatgggggttctgcaccatcgccttggaacaaatggtgtctgcctccacatctgcaatgactcagatctctgctctgggcatacttgcagtcaaatcagggctgcccagacatcctgtgtttgtgaaatgctgagaaagactaactggcttccagcagttgcctactcatccaccctcttccaaacacccaggctggggagtaacattttggggatgagtccttgtaatgctgcttctctctggagagcaatgtgtgaaaattgacccaaggagttgtctcatgggatgaggcataattggctgtcttttttcggaacctccttgaggctcatctacccccgtgccctgagctcactggggcctgcctggccaaacagaatatacccattaagggaataaatttccaggccacaataacaagcatcaccactttgaaaagaaaaagccatgaactgaaattcttcaaaataagaatttttaattagcccaataaacacattaaaagatataaggaagatactagaactatgaaacaaatgaacacaaaaacaccaaaaagaaccgacaagaaatactaagttgaaaacataacagttgaggctgggcacggtggctcaagcctgtaatcccagcactttgggaggccaaggagggtgaatcaactgaggtcaggagttcgagaccagcctgaccaatatggtgaaaccccgtctctactaaaaatacaaaaactagccaggcgtggtggtgcatgcctgtaatcccagctactcaggagactgaggcaggagaattgcttgaacctgggaggcagaggttgcagtgagccgaggtcgtgccacagcactacagcctgggtgacagagcaagactccatctcaaaaaaaaaaaaaagaaagaaaagaaaatataacagttaatgccaggtgcagcagctaactcctgtaatcacagcactttgggaggccgaggcgggcagatcacctgaggtcagaagtttgagaccagcctgaccaacatggagaaaccccgtctctactaaaaatacaaaattaaccaggtgtggtggcatttgcctgtaatcccagctactcaggaggctgaggcaggagaattgcttgaatccaggaggtggaagttgcggtgagccaagatcacagcattgcactccagcctgggcaatgagagcaaactctggctcaaaaaaaaaaaaaaaaaaaaggtgggggggcggggctcagtggctcaggcctgtaaccccagctctttggtgtagggaaaagaaagagagatcagactgtcactgtgtctatgtagaaaggaaaggcataagaaattccattttgacctataccttgaactattgctttgctgagatgttgttaatttgtaactttgccctagccacttcgccccagccacttcgccccagccactttgccccaactttgagctcacaaaaacatgtgttgtatggaatcaaggtttaagggttctagggttgtgcaggacgtgccttgttaacaaaatgtttacaagcagtatgcttggtaaaagtcattgccattctctagtctcaataaaccaggggcacaatgcactgtgaaaagctgcagggacctctgcgctgaaaagccggtattgtccaaggtttctccccatgtgatagtctgaaatatggcctcgtgagatgagaaagacctgactgtcccccagcctgacacccgtaaagggtctatgctgaggtggattagtaaaagaggaaagcctcttgcagttgagatagaggaaggccactgtctcctgcctgagataggagaaaaaccaccctatggcaggaggtgagacatgttggcagctatgctgccttgttattctttactccactgagatgtttgggcggagagaaacataaatctggcctacgtgcacatccaggcatagtacctccccttgaacttaattatgacatagattcttttgctcacattttttttttttttttttttgctgaccttctccttattatcaccctgctctcctactgcattcctcttgctaagataatgaaaataataatcaatacaaactgagggaactcagagaccagtgccagtgcatgtccttggtatgctgagtgccggtctcctggacccactgttgtttctctatactttgtctctgtgtcttatttcttttctcagtctctcatcccacctggcaagatatcccacaggtgtggaggggcaggtcacccctttacttttggaagccgaggcagggggatcacgaggtcaggagatcaagaccatcctggctaacatggtgaaaccccgtctctactaaaaatacgaaaaaaaaattagctgggcatggtgttgggtgcctgtagtcccagctactcgggaggctgaggcaggagaatggcatgaacccaggaggcagagcttgcagtgagctgagattgcaccactgcactccagcctgggtgacagagcgagactctgtctcaaaaaaaaaaaaaaaaaaagaaaaaaagaaaaaagaaaacataacagttgtactaaagaacacaaatgattgaataaactgcaggatggacagagctgaggaataaattagtggactggaataacagaaattcccctaaaggaagaagaaaaaagaacaggaaatataaaaagaatatacaaaatagaatataaaaaggaaatataaaagaatagctaagggatatggagaataaaagtgaaatggcaacattcagaagataggattcctggaaagagaaagagaaaaatggagaggaggaaatatttgaaaaaataaagaataaaaaattctcagaattaggaaaaaagatgaaatgtgaacacaagatctgtatacagattattcctcattaaaaataattttggccaagcgtggccaggcgcggtggctcacgaaatcatgccactgcactccagcctgggcgacagagcaagactctgtctcaaaaaaaaaaaaaacaaatttttggccaagcgtggtggctcacgcctgtaatcccagcactttgggaggcccaagaccagaggatctcttgaacctaggagttggagatcagtctgggtgggcaaaaccctgtctctaccaaaaaaaaaaaaaaaaaaaaattagcctggtgtggtggcacaaacctgtaggtaggagggtcgcttgagcctgggagatggaggctgcagtgagccatgatcactccactgcacttcagcctgggcaatagagcaagaccctgtctaaaaaaaaatattttggggaaatttaagaataccagagacaaaaagaacattctaaacatttccagagagtcagagatcacagataaaggaagaagaggcctatttacttatttatttatatctttttgagacagggtctcactctgttgcccaggctggagtgcagtggtgccatctgggttcactgcaacctctgcctcctgagttcaagcgattctcttgcctcagcctcctgagtagctgggactataggcgcccgccaccacgcctggctaattttttttttgtatttttagtagaaacggggtttaactgtgttagccaggatggtcttgatctcctgaacttgtgatccactgcctcagcctcccaaagtgctgggattacaggcatgagccaccacaccagcccggtttttcaatatacttgtccatgggtccctaaatgtcttgtcgtagattctttaaaaagagtgtttccaacatgctgaatcaaaaaaaaaaaaatggtttaactctgtgtaatggatctgttcatcacaaaacttttttacaggtagcttatttctagtttttatcacgggacattcagatttttaatacgggcctcaatgggctccacagtgtcccttcatagattctacaaaaagagtgtttccaccccgcccttcatagattttccataaacagtgttttcaacgtgctgaatgaaaacaatggtttaagtcttttagctgaatctactcatctgaaagcattttcacagatagcttgtttctagtttgtattgagagataatcgatttttcactataggcctcaataagcttctaaatgtccctttgtagattctttaaaaagagtgtttccaaccttgtgaatcaaaacaatggtttacctatgtgagatgaatgcacacatcacaaagcattttcacagatatcttgtttctactttttatcatgggatattcggttttccaccataggcctcactgggcttcataacgttcccttgtagattctacaaaatgaatgttttcaacctgctgaatcaaaacaaaggtttaaatctgtgagatgaatccagacatcacaaaggattttcacaggtaccttgtatgtcgtttttattaagggaaatttgatttttcccaacaggcctcaatgggctctaaatgatcccttcctagattctacaaaaagaatgtttccaaccttctgaatcaaaacaaagtttaactctgtgaaaggaatctgcacatagcaaagcattttcacacattgcttgtttctagttttaatggcaggatattcggtttttcacaatataccttaatgggcttcgaactgtccctttatagattttacaaaaggaatgttttctaactgctggatcaagacaaaggtttaactctgtgaaatgaatccgcacatctaaaagcatttccacagtttgcctgtttctagtttttatcgtggcatattcagattttcactataggcctcaatgtgctttgatacgtcccttcttagattttactcaatgagtgttttctacctactgaattaaaagaaaggtttaacactgtgagatgaatccacacattgcaaagaatttccacaggtagcatctttctaatttttatcgcaaatattcatttttttcacaataggcctcaatgggctctgaagtgtcccttcatagataccacaagaagcttgtttccaacctgctgaatcaaaacaaatgtttaactctgtgagataaatgcatgcatcataaagtattttcaaatataactagtttttagtttttatcatgggatattcagtttctcactataggctgcaatgggctaagaaatgtccctttgtagatactgcaaaaaagtgttaccaccctgctgaatcaaaacaagggtttaactctgtgaaataaatgaacacatcacaaagcattttcacagatagcttttttctaatttttatcgtgggatgctttttttccactataggcctcaatgtgctttgaaatgtccctttctagattctacaaaaaaggtatttaaaacctcctgaatcaaaacaaaagttaaactcagggagatgaatgcacatatttcagagaatttttacagatagcttgtttctagtttttatcacgggatattcattttttcactataggcctcatttggctccgaaaagttcctttgtagtttctaaaaataaagtgtttccaacccgcacttagtagattttactaaaacagtgttttcaacctttttaataaaaacaaaagtttaattatgtgacatgaatatacacatcacaaagtatttacatagatagcatgtttctagtttttatcatgggatatgcggttttttactgtaggcctaaatcagctctgaagtgtcccttcttaggttctagaagaacagtgtatcctacctgctgaaccaaaataatggtttagccctgtgagatgaatccacagatctcaaagcatgttcacagatagcttgtttctagtttttatcatggaatgcttggtttctcattataggcttcactgggctctaaaatatccattcgtagattctataaaaagagtgtttccaacctacttaatccaaataaatgtttcactctgtaaagtgaatccaaacatcacaaagcattttgatggatagcttgtttctagttttaatcatgggatattcagtctttttctgtagacttcaatggtctctgaaatgtcccattgtagattttacaaaaagagtgttgccagccagctgaatcaatacaaacgtttaactctgtgagataaatcttccatcacaaagcattttcacagatagcttgtttctggttttcaaggcgaaatattcagtttttcactataggcctcaatggactccaaaatgtttctttgtagattttacaaaagagtgtttccaacctgctgaaacaaaacaaaggttaaactgtgtgagatgaatccacactttgcaaatcattttcacaaattacttgtttctagtttttatcatggaatattcagttttccactgtaggcctcaatgggttccaaaatgtcccttcgcagatactacaaaaagagtgtttccaacctgctgaataaaaactaagatttagctctgtaaaatgaatccacacattgccaagcattttcaccaatagtttgtttctagttctaattgcaggatattcggtttttcactataggcctcaatggcctccaaaatgtccctttgtagatcccattaaaaggatgtttccaacctcccctttgtagattttacaaaaagagtatttccatcctgctgaataaaaacaaaggtttatctctgtgagatgaattcacacatcatgaaacattctcatatgtagcttgtttcaagtttttatagcgggatatttagttttatgactataggcctcaatgtgctccgaaatgtcactttgtaaactgtgtcaaaagagtatttccaacctgatgaataaaaataaaggtttaagtctgtgagatgaatccacacatcacaaaccattttcacagacagcttgtttctacttttcatcatgggatatttggttattcactatagacttcaatatgctctgagatgtccccttttagttctacaacagagtgtttcaaacctactgaatcaaaacaaagatttaactctgtgacatgaaatgacccattgtaaagcatttttacaggtagcttgttcctagtttttattgcagaatattcagttttttactacaggcctcaatgggctttgaaatgtcctcttgtagattctacaaaaagagtaattttggtctgctgaatcaaaacaaaagttaactctgtgagatacatccacacattgccaaggattttcacagatacatttttctagtttttatcatggaatatttggttttttactacagttctcaatgtactctgaaatatcccttaatatattcttgaataagtttgtctccaacctgctgagttaaaacaaagctttaactctgggagatgaatccacacatcacagcacattttcactgatagattgtttctactttttatcttgggacaatctgtttttgactataggcctcaatgggctttaaaatgtcccctcgtagattctacgaaaagagtgcttcaaacttgcttaatcaaagcaaaggttaaattatgtgagatgaagccacacatcacaaagcattttcacatatagcttgtttctagtttttatcatgggagatttgattttttactataggcctcaattggctctgaaatgtaaacttttatattctacaataaaagtgttttcaacctgctgaatcaaaacaaatgtttaactccatgagatgagtccacacatcacaaacattttcacaagcagcttgtttctaatttttattatgagatattcagtttttcagtacaagcctcaatgggctccaaaatgtttcttcatagattctaaaaatagagttgttccaacctgccaaatcaaaacaaacatttaactctgtgagataaatccatacattgcaaagcattttcacagatagcttgtttctagttgtttattgtgggatattttgtttctcactataaacctcaataggctctgaaatgtcccctcatagattctacaaaaaaagtgctttcatcctgctgaataaaaacaaaagtttaactctgtgacatgaaatgacacatcataaagcatttcgacagagagctttgttctagtttttgtcatggcacattcagtttttcactacaagccacagtgggctccaaaatgtcccttcgtggattctacaaaaagtgattttggcctgctgaatcaaaacaaaggttcaactctgtgagatgaatccacacatcacaaagaattttcacagatagcttgtttctagttttcatcctaggatattagggttttttcatgcatttcttcatgggctctgaaatgctcctttgtagattctacaaaaagtgtttccaacctgctgaatcataacaaaggtttaactctgtgagttgaatccacacatcatgaaacattctcatatgtagcttgtttctagtttttatctcgagatataaagtttttaactgtaggcctcaatgttctctgaaatgtgccttcttagattctacaaaaagagtatttccaacctgttgaatcaaaaccaaagtttaactctttgagatgaattgacacattgcaaagcattttcacagatagcttttttctagtttttgtcacagaaattcaggttttcactgttggccattgtggaccccaaaatggccctttgaagattctacaaaaagagtagttccaacctgctgaatcaaaacaaaggcttaaatctgtgagatgcattcacacattgcaaagcattttcacagatagcttttttctagtttttgtcacagaaattcagtttttcactgttggcctttgtggactccaaaatggcccttcatagattctgcaaaaagagtagttccaacctgctgaaacaaaacaaaggcttaaatctccacacattgcaaagcattttcacaaatagcttgtttctggtttttatcacaggatatttggtttttgactttagacctcaataggctccaaaatgtctcctcctagattatataaaaagattgtattccacgtgctgaatcaaaacacagttaacttggtgagatcaatctgcacatcacaaagcattttcacagatagcttgtttctcgtttttatcacaggatattcagtttttcactataggcctcaaagcacaccaaaaagtcttcttgtagatccaaaaacagactgtttccaacctgcttaatcaaaacaaagatttaactctgtgaaatgaatccacacatcccaaagcattttcacaggtagcttgtttctagtttatatctccagatattttgtttttcactacaggcttcaatgggctttgaaatgtttcttcatagattgtactaaaagagattttccaacctactgaattataacaaagatttaattctgtgagattaatctacacatcacaaagcattttcatagatagcttgtttctagtttttattatggtataatttgtctttcattgtaggcctcaatgggctttgaaatggcccttagtagattctgcaaaaagagtatttccaacctgctgaattaaaataattgtttaagtctgtgagacaaattcacacaatgcaaagcattttaacagatattttgcttgagtttttattgcaggatatttggtgtctcaatatactcttccatgggctccaaaatgtccctttgtatattctacaaaaagagtgtttccaacctgttgaataaaaacaaaggtttaattctgagagatgattccaaacatcacaagacctttggacagatagcttgtttctagttttcattgtgggatattcaacttttcaccgtagtcctcaaggagctttgtaatgtcttttcatggaatctacaaaaacagtgtttccaccctgctgaatcaacacaaatatttaactctgtgagatggatccacacatcccaaaacattttcataaatagtttgtttccatttttcatagaagaatatttgctttttctatatatttatccatgggctccaaaatgccccttcatagattctaaaaaaagaatagtttcaatctgctcattcaaaacatatgtttaataatctgagagataaatccacccatcacaaagcattttcacagatagcctgtttctagtttttaatttcaggatatttagtttttcattgtacacctcaatgggctccaaaatgtcccttcatagattctacaaaaagagtgattccagtctgtggaatcaaaacaaatgtttaactctgtgggatgaatccactgactgcaaagcattttcacagataggttttttctagtttttatcatgggatatttggttttttactcttggcctcaatgggcttcaaaatgtcccttcgtagattatacaaaaagagtgtttccaagctgctgaatcaaaacaaagaattaactctgtgacatgaatccacacatcacaaagcattttcacagatagactgtttctagtttttatcatgggatatttagtttttcactatagacctcaattggctctgaaatgtcccctcatagattcttcaaaaatagtatttccagctctgctaaatcaagacaagagattaactttgtgatatgaatatacatatggcaaataatttttagtgataagttgtttccagtgtttttgatgtgatattcagtttttcactgtaggcttcaatggcctctgaaatgtccacacgtaggtggtacaaaaggactgtttccaacatgctgaatcaaaacaaaggtttaactctatcagatgaatccaaacattgcaaaggattttcacaggtagcttgtttctagtttttatcgtgagatatttggatttttactaatggccctaatggactctaaaatgtcccttcttagattttacaaagagagtgtttccaacctgcttaatcaaaacaaaggtttaactctgtgagatgaatctacacatcacaaagcatttttagaaatagactttttattgttattgttgcaaaatattcagatttttaccgtaggcattaatgggtgttgttgggaaaaggtgagtgttgggagaagctgagacagggcttgcatgtctgacataatgtaaaagagtcttggaacatgtccagggtccagggtctaaaaccccttgtggcatttggaacaccaaagtctgtgctaaagggtggaaggctatccagatgcacaataatctaagcccagggcataaaatccctgatggcagggatagaatccagggtttgtggctttggaatgtgtccagaattgctggatccttgctccttgctctcccagaattgattgtatcttgagttagaagaacctgctctccattatctcaagtagcagagcaaatgctaaaccatcacagctgtaaatcatgtgtttaatgcaacacactcttttgaccacattctcaccacctgtttctttgttggattaccaataaatactacgggcttccagagctcaaggccttcatagcctccatgatcgtgatggaccctggtcccactttacttctcaaactgtctttttctcaatcatttgactccaccggacttcatcaaccccacaacctggtgttgggtctgatcaccccaacaggtgtgatgtatcctttcataaatccatgcattgcaaagtattttcaaagatagcttgcttgtagtttttatcacgggatattcaggttttcactattggcctcaatgggctctgacatgtttcttcatagattctacaaagggagtgtttcaaacctactgaatcagaagaaaggtttaattctgtgagatgaatccacacattgcaaagcattttcacagatacttttcttctagtttttgtcaaaggatattcagtttttcagtataggcttcagtgggctctgaaatatcccttcgcagattctacaaaaggagcgtttccaatctgctgaataaaaacaaaggtttaactctgtgagatgaatccatactactcaaagcattttcacagatggcttgtttctaacctttataatgagacattcaatttttcactattggcctcaatgggctccatagtgtctcttcctagattctacaaaaacagatttttcatttctccaaatcaaaataaaagtttactctgtgatatgaaatcacacatcacaaaggattttcacagatagctttttctagtttttatcataggatattgggtttttgactataggcttcagtggactcttaattgtaccttcttaaatgctacaataaagtattttcaacttgctggatcaaaacaaaggtttgactttgtgagacgaatcctcacatcgcaaagcattttcacccatagcttgtttctagtttttaccgagagatattattttttcactagaggcctcaatgggctcctaattgtccccttgtagattctacaaacaaagagtctaacctgctgaagcaaaacaaagtttaactttgtaagatagacctacacatcacaaagcattttcacagataggttgtttttagtttttatcaagggatatttgatttttcactgtaggtctcaatgggctatgaaatgtcccctctagatccacaaaaaaaagtttccaacctgttgaatcaaaagaaaagttcaacttgtgaaatgaaatcacacatcataaagtattttcagagatagcttctttatagtttctatcactggatatttggtttttcactatagacctcaatgaacttcaaaatgtctctttgtagattctacaacaagagtgtatccaacctgcagaataaaagcaaaggtttaactctgtgagatgaatccacacatcacaaagcattttcagagataattttttttattgtttttatcgcaaaatactcacttttttactataggcttttataggtgtgaaacatccctttgtatattctacaaaaaggtattccaaacttgctgaataaatgcagaggtttaaatttgtgacatgaatccacatattgcacagcatttttactgacagcttttttctagtttttatcacgggataatcagtttttcagtataggcctcaatttggtccgaatagtaccctagtagattgtagaaaaagagggtttccaacctgctgaattacaagaaaggttaaactctgtgagataaaatcacacattgtaaagaatttttagacatagcttctttgtagtttttattacaggacatttgattttttactataggcctcaatgagctctgatatttcccctggtagattgtacaaaaagagcatatccaatctgctgaatcaaaacaaacatttaactctgtaagacaaatctacatatcgccatgcattttcacagatagcttgcctctagtttttatcacgggatatttgatttttcactataggcctcaatgggctccaaaatgttgcttcatagattctacaaaaagagtgtttccaacctgctgaatcaaaagaaaggtttaactttttgagataaatacacgcattgcaaaacatttttacaggtagttcattttagtttttatcatgggatattccatttctcactataggaatgaatgggctctgaaatgtcacttcaaagattctacaaagagagtgtttccaacctgctgaatcaaaacaaacatttaacttgttgagatgaatcctcacatcactaagcattttcacagatagattgtttttagttttatcatgggatattcagtttttgattataggcctcaaagactgaattgtggccaagcagatagtaaaacatatgtgtctccaaccttctgaataaaaatcaaaatttaactatgtgagatacatccatatatcacaaagcatatttacagatagccagtttctagttttaatcatgggatattcagtttttcactacaggccttaatgggctcaaaaaagactcctcttattctactaaatatttgcttccaatgtactgtataataacaaatattaaacgctgtgaaagaaatccacagatcacaatgctttttcacaaatagcttgtttctagtttttatcacaggatatttggtttttcactgtaggcctcaatgggctatgaaatgttcctttgtagattctataaaaagtgtgtttccaacttgctgacttaaaataaaggttttacactgtgagatgaatccacacattgcaaagcattttcacagatagcttgtttctttttcttatcatgggatattcagtatttaactagagacttcaatgggctctggaatgtcccatagtaaactctatacaaagagtgtttccaactggctgaataaaaacaaaggtttacgtctgtgaggtgaatccacacaacacaaagcattttcactgacagcttgtttctagttttatagcaggattttttttcaatattggtctcaatgggctccaaaatgtccctttgtagattctacaaaatttttttccaacatactgaatcaaaacaaatgtttaacactgtgagatgaattttcacatcaaaaagcatttttacagtagtttgtattagtttttattatgaaattttgaatttttcactgctagcctcaaaattgtcccctattagattctactaaaagaatatttccaacctactgtatagaaacaaaagtttaactctgtgaaatgaatccacacattgcaaacctacttcacagatagcttgtgtctagtttttatcaagaattatttggcttttcactataggcctcaatgggctccaaaatgtcccttcatatattttgctaaaagagtgtttccaacctagctgaatcaaaagaaagtttaaactctatgaggtgaaactgcaaattgcaaagcattttcacatatagcttctatagtttctatcatggaatattcagtttttcactatcggcctccatgggctatgaaatgtcccctcgtaggttctacaaaaaaagtgtttctaacatgttgcatgaaaacaaagatttaactttgggagatgaacccacacattgcaaagcatttctatagaaagattttttctagtttttatcacaggatattagatttcatactgtaggcctcattttgctccaaatttaccccttgtcaattctacaaagagaatatttccaacctgctgattcaaaacaaatgttcaattctgtgagatgacatgcaaagcttttcacagatagcctgtttctagttttcatcataggacatttggtttttcactataagcatcaaagggctctgaaatgtccctttgtagattctacaaaaagagtgttcccaacctgatgaatcgaaagaaaattttaactttgtaagatgaatccacacatcacaaagcattttcactcatagcttgtttctagtttttatcgtgggttattggttttcactaaatgcctcaatgagctatgaacagtcccttgtagattctacaaagaaagaatttccaatctgctgaagcaaaacaaagttttaactttgtaagatgaatctacacatcacaaagcatttttacaaaaggttgtttttagtttttatcaagagatattctatttttcacagtacacctcaatgtgctacaaaatgtcccctagtagattctacaaaaaaactttctaaactgctgaatcaaaagaaaagttcaactggtgagatgaaatcacacatcacaaagtattttcagagatagcttctttatagtttttatcatgggatattagatttttcaatataagcctcaatgagctctgaaatatccctttgtagattctacaaaaaaagtgtttccaacctgcaaaataaaaaggaaggtttaattctgtgagataaatccacacattgcaaatcatcttcacagttggcttgtttctaatttttattgtggaatatttggcttttcactgaaattctcaagtgctctgaaatgtccctttgtagattctataacaagagtgttttcaaactgctgaatgaaaacaaaggtataacgctttaagaggaatccacacatcacaaagcatatattcagatatcttgtttctagtttttaaagcatgatatttggtttttcactataaccctcaatgggctcagaaatgtctcatagtagattttacaaaaacagtatttcctacctgctaaatcaaagcaacagcttaaatctgtgagattaatccaaacctcgcaaagcattttcacagatagcttactcctagtttttatcgcaggatatttggattttcagtataggcttcaatgggctctgaaatgtccattcataagttatataaaaagtatgttcccaaacccctgaaaaaaaaatgaaggtttaactctatgagatgaatccacacgatgcaaagcattttcacagatagcttgtttctagcttttatgatgagacattcgaatttttactattggcctcaatggggtcagaaatgtctttttgtagattctacaaaaaaaaaaggcttttatttttctgaatcaaaataaaggtttaactcttctatatgaaatcacacatctcaaagtattttcacagataacttgtttctagtgtttatcactggatattgggtttttcactataggcttcagtggactcttaattgtaacttcttaattcttcaaaaagtgtgtttccaacctgctgtatgtaagtaagtgtttacctctgtgagacaaatcttcacattgcaaagcattttccccaatagcttgtttgtagttttaattgcataatatttggttttgtactataatcctcaatgggcaccgaagtgtcccttcgtagattatatgaaaacagtgtttctaacctgttgaatcaaaacaaaggtttaactgtcagatgaatctacacattgcaaagcattttcacaggtagcttgtttcaagttttcatcgcaggatatacgtttcttcattataggccccaagagctccaaaatgtcttagagtatttcaaacctgcagcataaaaacaaaggtttaactttgagacaaatgcatacatcacaaagaattttcacagaaagcttgtttctagtttttatcaggagatactcagtttttcactatagacctcaaggggctttgaaacatcccttcatagattacacaaaaagattgtttccaccttgctgaaacaaacaaacaaaaaattaactctttgagatgaatcaacacattgcaaatctattcacagatagcttgtttctagtttttttttttttttttttgaagggtattctgtttttcactataggcaccaataggctcctaaatgtccctccgtagattctacaaaaagagtgtttccaacctgctgaaccaaaagaaaggtttaattctatgagatgaaatcatgcacaagaaagcatttttttgagataccttttttatagtttttatcactggatattctatttttcacagtaagcctcaatgggctttgaaatatctctttgtcgattgtaccaaaggagagtttccaatttcctgaatcaaaacaaaggtttaatgttgtgagataaatccacaaattgcaaaacattttgacagaaaacttgtttctagtttttatcacaggatatttggttttcattataggcctcagtgggctaagaaatgtcccctcatcaaatctacaaaataggtttctccaacctgctgaatcaaaattaacattcaactctgtgaaatgaatccacacatcacaaagcctttttttttttgatggaatctcactctatgacccacgctgccgtacagtggtgtgacctcagctcacagcaacctccacctcctgggttcaagcaattctcctgcctcagcctcctgagtagataggagtacaggcacacaccaccatgcccagctatttttttttttgtatttttagtagagacagggtttcaaaatgttggccaggctgctcttgaactcctgactgcaggtaatccaccagcctcagccttccaaagtgctgggattacaggtgtgagccactgcacccagccacaaaacattttcacagatagctagtttctagtttttatcaccagatattcagtttttcactattgtccacagtgggctttgaaatgtccccttgtagattctacaaaaatagtgtttttgacctgccaagtcaaaacaaatgataaactctgtgagatgaaactacacatttcaaaacatttttacagatagcgtattctagtttttaatcatgatatattcactttttcactctaggccccaatgggcttggaaatgttttttcattgattctacaaaaaaaaattgtttccaactttttaaatcaaaacaaatatttaactctgtgagatgaattcacaaatcacaaaatattttcacagataatatgtttctagtttttatcaagggttgttcttttttttattgtaggcctcagtgggctctgaaatgtccccttatagattttataagaaaagtttctccaagctgctgaatcagaagaaaagttaactctatgagataaaatcacacatcacaaagcattttcagagatagttttttaaatagtttttatcattaaatattcattttttcagtatttgcctccatgggctctgaaaagtactatcaaagagtaaacaaaattagtgtttccaacatacttagtcaaaacaaaggtttaactctgtgagatgaatccacacattgcaaagcattttaacagatagcttgtttctaatatgtatcatgggatattcagtttttcaatataagcctcaaagggttctgaaatggaacttcttagattctacaaagagactgttttcaacctcctgaataaaaacaaagatttaactccatgagatgaatccacacatctcaaagcattttcacaaatagattttatctactttttatcatggaatattgggtttttcacaataggcttcaatggactctatatcatcccctattaaattctacaaaatgagtgtttccaacatgctgtatataaacagaggttaactctttgagatgaatctatatacacaaagcatttgcacagagaacatgtttctagttttcgtagtgaaatattcagttttcagtctataagacctcaatgggctctgaaatgtcccttcatagattgtacaaaagtgggtttccaaactgcagaatcaaaacaaaggtttaactctgtgagatgaatccacacaacacaaagcattttcactaataatttgttgctagtttctatcatgggatatttggtttgtcaatatgctcatccatggaaaccaaaatgttcctttgtagattcttaaaaaaaaagtgtttccaatctgctgaatcaaagcaaatgtttaactctgagagatgatccacacatcacaaagcattttcacagaaatcttgattctcatttttatcagggaatatttagtttttcaccataggcctcaatgggctttgaaatgtcccctcttagacaaaaaaaaaaaaaaaaaaaaaaagtgtttccaacctttgaattacaactaaggtttaactctatgagatgaatccacacattacaaagcattttcacagatagcttgtttctagtttttatagagggatatccagtttttcactatatgcctcaatgggtttaaaaatgacccttcatagattccacaaaaagagtgtttccaaactgttgaatcaaaacaaagttttaactctgtaaaatgaatgaacatatcacaaagcatttttgtagatagcttgtttctagtttttatcacaggatattctggttttcactacaggcctcaaagagctccaagatgtcccttcatagattctacaaaaagagtgtttccaacctcctcaatctaaagaaaaatttaactcattgagatgcccacattgcaaagcattttcacacacagctcctttctagtttttttgctggatatgcggttttttcactataggcctaaacaggctccaaagtgtcccttttagattctacaataacagttttttctacctactaaatcaaaacaaaggtttaactctgtgagatgaacccacacatcgcaaagcatgtttacagatagcttgtttccagtttttatcatgggatgttggatttttcactgtagacctcaatgggctctgaaatgtccccttgtagatcctacaaaaagagtgtttcctacctatgaaatcaaaacaaaggtttacctctgtaaaatgaatgcaaactgcacaaattattttcacagatagcttgtttctagttttaatcacgagatattcactcttacaccataggcctcaatcagcttagaaatgttgccttgtagattctacaaaagagtgttttcaacctgctgaatgaaagcaaaggtttaactctgtaaaatgaatgaacacattgcaaagcattttcacatagagtttgtttctattttttttttgtgggatattttgttttccactctaggcctcaataggctctgaaatgtcccttcacagattctacaaaaagagcatttctaacctgctgaataaaaacaaagatttaactctgtaaaattaatccacacatcagcaagtattttcacggatagcttgtttctagcttgaatcacgaaatattaggttttttattatagacctcaatgggctccaaaaaggccctttgttcattccacaaaaaaaagcatttccaacctgttgaatcaaaacaaaggtttaactccatgagatgaatccacacattgccaatcaagttcacacatagattgtttttagtttttattgtgaaatattcaattttttactgtaggcttcaatgatctccaaaatgtattttttgtgtattctacaaaatgattgccccaactttcttagtgaaaataaagtttaactctctcagataaatccacacattgcaaagcattttcacaaataaatagttgttagtttctatcataggatatttggtttatcaatatatatgcacatgggctccaaaatatccctttgtcaatgcttcaaaaagggtgttcttaaactgctgaatcaaaacaaagttttaattctgagacccacatattagaaagcattttcacagatagcttgattctagtttttatagggaatattcagtttttcaccataggcctcgacgggctccaaaatgtccctttgtagattctacaaaaaaaaagtgttcccagcctgttgaatcaaaaccaaagtttaactttgtgagatgaatccacacatcacaaagcattttcacagatagcttatttctagttttcattgcaggatattcagtttctcaatatagtcctccttgggctctgaaatgttgcttcatggattctaaaaatatagtgtttccaacctgctgattcaaagcaaaggtataattctgtgagagaaatccacacatcacaaagcattttcaaagacagcttgtttctagtttttaacatgggatattcagtttttcagtataggcctcaatttgctccaaaatgtcttttcgtagattcaagaaaaagagtgtttccaacctgctaaatcaaaagaaaggtttgactctgtgagataaaatcacacattacagagcattttcagacatagcttttttatagtttttattatgggacatttggttttttactatatgcctcaatgggctccaaaatatcccctcatagactgtacaaaagagcatttccaacttactgaatcaaaatgaaggtttaactctgtgagatgaatttactcatggcaaaaaattttcacagatagcttgctttgtgtttttatcacaggatattccgtttttctccataagcctcaatgggctccaaaatattcctttgtagattttacaaaaaaagtgtttcaaaactactgaatcaaaaccaaagtttaactctgtgagatgaatccacacatcgcaaatcattttcataaatagcttttttctagtctttattgtgggacatttgattttttgccataaacctcaatggattctgaaatattgttttgtagattctataaaatgagtatttccaacctgctgaatcagaagaaaggtttaacactgtgagatgactccacacatcacaaagcattttcacagatacattgcttctagtttttcttgtgagatattcggttttcactataggcctcaaatggctctgaaatgtccctgcttagattctacaaaaaaaaagtgtttccaacctgctgaatcaaaacaaagttttaactctttgagataaatccacacattgcaaagcattttcacagatagatgtttctagtttttatcgtgggatattgatttttcactacatgccaaaatgggctccaaattgtccccttgtagaatctacaggcagggcattttcaacgtgctgatgcaaaacaaagttttaactgtgtgggatgaatctacacatcacaaagcatttttacagataccttgtttctagtttttatcacagtatatttggtttatcactatatgcctcagtttgctctgaaatgtcctatcatatattctacaaaaagagtgtttttttgtttgtttgtttgtttgttttgttttgttttgtttcatttttgagaatgagtctcgctcttttttgcccaggctggagtgcagtggtgtgatcttggctcactgcaagctccacctcccgggttcatgccattctcctgcctcagcctcctgagtagctgggactacagatgcctgccaccacacctggctaattttttgtatatttagtagagacagggttttcaccatgttggccaggatggtcttgatctcttgacttcgtgatccaccagcctcggcctcccagagtgctgggattacaggcatgagccaccatgcccagccaaaaagagtgtttttaacctgctgaatcaaaagaaaggtttaactctgtgaggtgaaattacacattgcaaagcattttcagagataacttctttattgtttttatagtgggatattaggtttttcactataagcctcaataggctttgaaatatctcccagttgattgtaaaaaaaagagagtttccaaactgctgaatcaaaacaaaagtttaacgtcatgagataaagccacaaattgcaaagaattttcacagataacttctttctggtttttatcacaggatattcagtctttcactatagtcctcagctgactgagaaatgtaccctcataggttctacaaaaagagtgtttccaacctgctgagtcaaaacaaaagttaaaatctgtgagatgaaatcacatattgcagaacatttttacagagagcttgttctagtttttagcatggcatattcggtttttcactataggcctcaataagctctgaaatgtcccttcatagattctacaaaaagagggtttccaacctgctaaatgaaaagaatagtttaactctgtgacatgaatccacacattgaaaaacattttcacacatagcttgtttctagtttttatcacgggatatccagtttttttagtacaggccactgtgagctccaaaatttacttctgtagatgctacaaaaagagtgtttccaaccttctgaatcaaaacagaggtttaactttgtgagatgaatccacaaatcttaaagcattttcacagataatgtttttttcagtttttattggggatatttggttttacatgataggcctcaaaggactcagaaatttcttcttttagattctactaacagagtgttgccaacctgctgtatataaacataggtttaactctgtgagataaagccacacatcacaaacattttcacagttagcttgtttctagtttttatcaaaagatatttggtttttcactataggttctaatgggctctgaaatgtctcctcatagattatacatcagtttacaaactgctgaatcaaaaacaaaaaagggtttacctctgtggaataaatccaaacatttcaaagataattcacaggcagcttgtttctagactttaccatggcatattggtttttcactataggcctcaacaggctcggaaatgttttttggttgattctacaaaaaaagtgtttccaaccttttgaatcaaaacaaagtttaaactctgtgagatgaattcacacatctcagtgtgttttcacagatagcttgtttgtagtttttgtcaagggatattcatttatttattgtcacactcactgagctctgaagtatcccctcatagattccacaaggaaagtgtttacaaactgctgaatcagaagaaaagtttaactctgtgagatgaaatcacatgtcataaagcattttcagagatagcttctttatagtttttatcaagatatattcagtttttcagaattggcctcaaggggctccaaaatgtcctctcgtagagtctacaaaattagtgtttccagactattgaatcagaacaagggtttaactctgtaagaaaaatccacacattgcaaagcattttcacagatagcttgattctagtttttatcagggaatatttggttattcaccataggactcaatgggctttgaaatgtctcttcttagattctacaaaaaaagtgcttccaaccttctgaattaaaagtaaggtttaactctatgagatgaatttgcacatcacaaagcattttcacagatagcttgtttctagtttttatcatgggatatctggtttttactataggcctcaatgggcttcaaaatgatccttcatagattctactaaaagagtgtttccaacctgtttaatagaaacaaatgtttaattatgtgagatgattccacacatggtgaagcattttaccacacagcttgtttctagtttttattggttttttactataggccttcatgggctccgaaatgtcccttggtggattctacaaaaagagtatttaccgtctgctgaatcaaaacaaggctttaactctgtgagatgaatccacacatggcaaagtgtttttacagatagtttgttttcagtttttattgggaaatatttggtttttcttaataggcctcaaagggctcagaaatgtcttttttctaattctactaaaagagtgtttccaacctctgtatataaacataggtttaactctgtgagataaatccatacattgcaaagctaattcacagatagcttgtttctaatttttatcaccagatattggtttttcaatataatctttgagatcaactcacacattgcaaagcattttcacagatagctttttttagtttttatcaagggatattcactttttattgtaggactcaataggctctgaaatgccctttcatagattctacaaaagaaattgtttccaacctgctgaatcaagaaaagttaaactccgtgggatgaaatcacacatcacaaagcattttcagagatagttttattatagtttacaccacaaaatatttggtttttcagggttggcctcaacaaaattttaactctgtgagatgaatccacacatcacagagcatttttcacaaatagcttttttctggtttttatcgtgggataactggtttttcaatataaacatcaatgggcttcaaaatattcctccttagattttactaagagactattatcaacttcctaaatacaaacaatggttaaatcagtaagatgaatccacacattacaaagcattttcacagataaactttttttactttttctcacagaatattgcattttttcactataggcctcaatggactctaaattgccctctctcacattttacaaaaacagtgtttccaacctactgtatataaacaaaggtttacctgtctgagtagaatctacacacgcaaagcattttcctagataacgttttcagttttcattgtgaaacaatcagtgtttcactataggtctcaatgggttccaaaatgtcccttcgtagattctacaaataaggtgtttccaacctgctgaaacaaaactaaggtttaacactgagagatgaatccacacattgcaaagcatcttcacagatagcttatttctagtttttatcatggaatatttggttttacactataggactcaaagccctcagaaatttattcttttagattcaagtaaaagagtttttcatacctgcagtataaaaacaaaggtttacttctgtgggataaactcacacattgccaagcatattcacagatagcttgtttctagtttttatcacaggatgtttagtttttcactaaggctcaatgggctttgaaacattcctctgtagagtgtacaaatttgacctgctgaatcaaaacaacgtttaactttttgagatgaatccacacatcacaaagcattttcacagaggcttgtttctagtttttattgcaggatattggtttttctctacaggtcaatattgtctttgaattgtcccctcatagattctacaaacaccgagcttccaagccaatgaagcaaaagaaagtttaactttgtaagatgaatctacatattgcaaagcatttttaaaagatagcttgtttttagcttttattgctggatattcagtttttcactgtaggcctcaatttgctctgaaatgttttattgaagatctacacaaagagtgtttccaaccactgaatcaaaagaaacgtttaactctgtgagattaaatcacacattgcaaagcattttgagagacagcttcatatagatttatcatgggatatttggtttttcactgtaagcctcaataagctttaaaatgtctcttcatagattgcacaaaaaaagagtttccaacctgctgaaaaaaaaagttttaacgttgtgagatgaatccacctattgcaaagcgttttcacaaatatcattttttctagttttcatcgtggaatattgtttttaagtgtaagcctcagtgggctcaaaaatacccctcatagattctacaaaaagagtttttctaacctgctgaatcaaagcaatagttcaactctttgagttgaatccacacatcacaaagcaatttcacagatagcttgtttccagtttttatcacgagatatttggttttttactgtaggcctcactagctcagaatttttccctcttagattctactaaaacagtgtttccaaaatgccatataaaaataaagttttaactctgtgtgatgaatctacacattgcaaaccattttcagacatagattatttctagtttttatcatgagatattctgtttttcactataggcctcaaaggtctccgaaatgtccctttgcagattctacaaaatgagggttttcaacctgctgaatataaagagaggtttaattctgtgagataaatccacacatcacaaaacattttcactgatagtttttttcaagttttttatcgtgtgatatttgatttttcactataggcccaatgggatccaaaatttctctttgtagattctataaaaaagtattttcaacctgccaaatcaaaacaaggttttaactgcatgagatagatctacacatcataaagcattttcacaaattgtttgttctagtttttatacggggatattttgttttttactataggccacagagagctcagaaatgtcttcttttagattctgcaagaagaatgttttccacctgctgtatataaatataggcttaactctaggagaaacatctgcacatcacaaacattttcacagatagcttgtttctagtttttatcacgggatatttggtttctcactagaggcctcaataggcccctaagtgtccctttgtagattctaaaaaaaagtttccaatttgctgcataaaaacaaaggtttaactctgtgagatgtgtgcacacatcataaagcattttctcagaaggattatttttagttttttcatgagatactctgtttttcatttgaggccacattgagatctgaaaaatccctatgtagattctacaaaaagagtgtttccagcctgcagaatcaaaccaaggtttaattctgagagatcattccaaacatcatgagacacttttacagataggttgtttctaggtttaattgtgggatattcagttttttaatataggcctcaaagggctctgaaatgtcccttcatagattctatgaaaagagtgtttccaactggctgaatcaaaacaaatgtataactctgtgagagaaatccacacatcacaaagcattttcactgacagcttgtttcaagtttttattgcaggataatcagtttttgactataggcctcaatgggctttaaaatgtaccttcatggtttctacaagaagagtgcttcaaacctgcttactcaaagcaaaggtttaattctgtgagatgaatccacacatcacaaagcattttcacgtatagcatgtttctagtattgatcactggatatttggtttggtttttcactgcagacctcaataggctctcaaatatccccctcatagattctacaaaaagaaagtgctttcaacctgctgaatcaaaacaaagttttaactttgtgacatgaaatgacacatcataaagaattttcacagatagcttggttatggtttttatcgtgtgtattcatttttccactacaggccacagtgggctccaaaatgtccactcaggcctacaaaaagagagatttttgcctgctgaatcaaaacaagggtttagctctgtgaggtgaatccacacatctcaaagaattttcacaaataccttgtttccagttttcgtcacaggatgttggtttttttcatatgcttcttcatgggatctgaaatgtcccttcatagattctataaaaagaatatttccaaccagctgaatcaaaacaaaagcttaactctgtgagttgaatccacacatcacaaagcattgtcatatatagcttgtttcaagtttttatcttgagatataaggtttttaactgtagggcccaatgttctctgaatgtgccttcttagattctacaaaaagagtgtttccgacctgttgaatcaagatagaggtttaactctgtgacatgaattgacacattgcaaagcgttttcacagatagcttttttctagtttttgtcactggatattcagtttttcactattggccttagtggattcccaaatttcctttcatagattctacaaaaagagtgtttccaatctgctgacaaaacagagctttaaatctgtgagatgtatccacacattgcaaagcatttttacaaatagcttgtttctagtttttatcacaggatatttggttttccactatagacctcaataggttcccaaatgtccccttgtagattgtacaaaaggagtgctttccatgtgctgaatcaaaacaaaggttttactccatgagatgaatccacacattggaaagcatttccacagatagcttgtttctcatttttattgtgaaatatttggtttttcactgtaggccttaatgtgcaccaaaatatcttctcgtaggttctacaaacagactgttcccaacctgcttaatcaaaacaaaggtttaactccgtgatatgaattaacacattctaaagcattttcacagatagcctgtttctagtttttatttccacttttttttcactattggcttcaatatgctttaaaatgtttcttcatagattctacaaaaagagttttccaaactgctggattaaaacaaaggtttaactttgtgagataaattcacacatcacaaaacatttttgcagatagcttgtttctagtttttatcatgggatatttggtctttcactgtaggcctaaatgggcttcaaaatggcctttagtagattctacaaagagagaatttccaatctgctgaatgaaaaagaatgtttaactctgtgagattaatccacacaatgcaaaacattttcagaggtagcttgtctttagtttttattgcaggatatcggtgtttcaatgtacttgtttatgggctccaaaatgtcccattgtatattctacaaaaagagtgtttccaatctgctgaataaaaacaaaggtttaactctgagagatgattccacacatcacagtacctttttacacatagcctgtttctagttttcattgcaggatatttagcttttcactataggcctcaatgagctttgtaatgtcctttcatataatctacaaaaagaggatttccagccttctgaatcaaaacaaacatttaactctgtgagatggatccacacatcccaaagcattttcatagatagcttgtttctactatttatcaaaggatattcgctttttctatttacttctccatgggctccaaaatgtcccttcatagattccacaaaaagagcatttcctaaatgctaaatcaaaacaaaggtttacctctgtgagttgaatccacacatttcaaagcattatcacagatagcttgtttctcatttttaatgcggatattcagtttttactataggcctcaatgtgcaccaaaatgtcttgttgtagattctgcagactgtttacaacctgcttaatcaaaacaaagttttaattctgtaatatgaatccacacatcacaaagtattttgacggatagcttgtttctagtttttatctccacatattttgtttttcactgcaagcttcaatgggctttgaaatgtttctttgtagattctacaaaaagagattttttttaacctactgaattaaaacaaaggtttaactctgtgagatgaatccacacatcatgaagcattttcacagatagcttgcttctagtttttatcgcaggatatttgttctttcactgtaggcctaaatgggctccaaaatggcctttagttgattctacagagagagtgtttccaacctgctgaatcgaaataaatatttcactctgtgagatgaatccacacaatgcaaagcattttcagaggtagcttgtttttagtttttattgcaggatattatattcagtgtttcaatatactcatttatgggttctgaaatgtcccttcatatattccacaaaaagtgtttccaacctgctgaataaaagcaaatgtttaactctgagagatgattccacacatcacaatatcttttgatcgatagcctgcttctagtttcatcacgggatattcagcttttcaccataggcctaaataagatttgtaatgtcttttcatagaatctacaaatagagttcttccagcctgctgaatcaaaacaaacatttaactctttgagatggacccacaaatcccaaagcattttcatagatagcttgttcctactgtttatcaaagaatattcactttttccatttatttctctatgggctctgaaatgtccctttatagattctacagaaagagtgtttcctattggctaaatcaaaacaaagttttacctctatgagttgaatccacacatcacaaaggattttcacagataatttgtttctcatttttgatatgggatattcagtttttactataggcctcaatgtgcaccaaaatgtcctgtagattctacaaacagactgtttacaacttgcttaatcaaaacaaagttttaattctgtgatatgaatccatacattgcaaagcattttgacagcttgtttctagtttttatctccacatattttgtttttcactacaggcttcaataggcttttaaatatttatttgtagattatacaaaaagagtttttttaacctgctgactgaaaaaaaggtttaactctgtgagatgaatccacacaatgcaaagcattttcatagatagcttgtttttagttttcatggcaggatatttggtcttttactgtaggcctcaatgggctctgatatggcccttagcagattctacaaaaagagtgtttccaacctgctgaatcaaaataagtgtttaagtctgtaagatgaatccacacaacaaaaagaatttttacagatagcttctttgtagtttttattgcaagatattcaatgtttcaatatactcatccatgggctccaaaatgtttcttggtatattctacaaaaagaacgtttccaacctgctgaataaaaacaaagatttagctatgagagattattccacacatcacaagaccttttgacagatagcttgtttctagttttcatcatagatagtcaacttttcactacaggcctcaattaactttggaatatcctttcatagaatctacaaaaagagtgtttccagcctgcaaacaagggttaaccctgtgagatggatccacacatcccaaaccattttcacaaatagcttgtttctccttttcatcaaaggatatttgctttttccatatacttctccatgggctctgaaatatcacttcacagattctacaaaaagagtttccaacctgctgaatcaaaacaaaggtttaactctgtgaaatgaatccacacatttcaaagcattttcacagatagcttttctctattttacgttgcgggatatttgattttttgctatactcgtccacgggctccaaaatgtccttttgtagatactacaaaaagagtctttttaatctgctcaatcaaaacaaatgtttaactctgggagatgaatctctgcatggcaaagcatttttatagatagcttgtttctagttttccttgtgggatattcagtttttcactgtaggcctcaatgggttctgaaatgtcactctgtagacaaagggacaaacagagtgattccgtcctgctgaatcaaaacaaaggtttacctttttgtgatgaatccacacatcgcaaagcattttcacagtttctttctagtttttatcgtgggatattcagtgttttactcttggccttaatggactctgacatgtcccttcatagattctataaaaagagtgtttccaacctgctaaatcaaaacaaatgtttaactctgtgggaagtattgacacatcacaaagcaatttcacagatagcttgtttctagtttttattgtgggatatttggtttttcaccgtagaccaaaattggctccaaaatgtacccttgcagattctacaagaagagtgtttccaactgctgaatcaagacaaaggattaactctgtgagataaatatacacatggcaaagagtttttagtgataggttgtttctagtttctttagtgggatattcaatttttcactgtaggcctcaatggcctctgaaatgtcccacagagatggtacaaaaagactgtttccaatgtgctgaataaatacaaaggtttaactctatcagatgaatccaaacatcacaaagcattttcacaggtagcttttttctagtttttattgtgggatgtttggtttttcactattggccctaatgggctccaaaatatcctttcttagattctacaaagagactgtctacaacctgcttaattaaaacaaagatttaactctttgagatgaatccacacatcataaaacattttcagagatagaatttttgttatttttattgcaaaatattcggttttttactataggcatcaatgggtatgaaatgtcctttgtatattctatttaaaaaagtttttttttaacctgttgaataaatacaaaggtttaactctgtgagatgaatccacatattgcaaagcattttcaaagatagattgtttctactttttattgcaggataatcagtgtttcactatgggcctcaatgggcttcaaaatatccctttgtagattttacaaaaagatattttccaatctgctgaatcaagacaaaggattcaatctatgagatgaatccacacattgcaaaaaatttttacttagaggctgtttctagtttttatcatgggataatgggttgttcatcaacgtgctgaatcacaaaaaggtgtaactctgtgagatggaatcacacattgcaaataattttcagacacagttatttgttattgctataatgggatgttcaacttttctctgtaggcttcaacaggcttctaaaactcttttcatagattgtacagaaagggtgtatccaaagagctgaatcaaaacaaaggtttaattctgtgagataaatccacacatcacaaggtattttcacatatagcttgtttttagtttttattgtgtgatgttcggtttgtcaatgggctctgaaatgtttctttgttgaatctacgaaaggaaagttttcaatctgctgaatcagaaaaaaggtttaactctgtgaaatgaatccacacaatgtaaaacattttcacagatggcttgtttctagtttttaccatgggatattcggtttttcactacaggtctcaatgacctccaaagtgtcccttcttagatcctccaaaaaaattgtttccaacctgctgaataataacaaaggtttaactctgtgagctgaatccacacatggcaaagcgtattcagagatatattttttattgtttctattacaaaatattggtttattactataagcatcaatgggtgtgaaatgtccctttgtatactctataaaacaagtgttcacaatctgctgagtaaaagagaggtttagctctgtgagatgaaatcacacattgcaaagcattttcagacatagtttctttttagtttttattgatgaacattcgttttttcactatacttctcaatgggtctatgtacctttgtagactgtacaaaaagagtgtatccaacttgcagaatcacagcaaaggtttaactctgtcagataaatccaaatatcacaaagtgttctcacagatcacttgcttctagtttttatcatgagatattctgtttttcactataggcctcaatgggctctgaaacatgttttcctagattctacaaaaaaaagtgttaacaatctgctgaatcagaagaaaggtttaacactgtgagatgaatccgcagattgcaaagcattttcacaaaaagctttcttttagtttttttattgaaaatattcagtttttcactataggcctcaatgggcttccaaataacttttctgaaattctacaaaaaaagtgtttccaacctgctgaatgaaaacaaaggtttaactctgtgagatgaatccacacattgcaaagcatttttacaaatagggtttctagtttttatcgtgggataatcaatttttcactataggccttaatgaactacgaaaaggctcttcatagtttccacagttaaagtgtttgcaacctgttgaaacaaaacaaaggtttaactctgtgagatagatccacacattgcaaaacattttcactgatagcttgtttctagtttctatcacaggatacacagtttttcactatatgcctcaatgggcttaaaaaagttccttcgcagattctacagaaagagtttttccaacctactaaaaaaaaaaaagtttaactctgtgagatgaattcacacatagcaaagtgttttcactgattgcttgtttctactttatatcgtgaaatatttggttttttagtataggcctcaatgggctctgaaactttccttttcagattctacaaaaagagtgtttttaacttattcaatctaaagaaagttttacctttgtaagatgaatccaaacatcacaaagcatattcacagatagcaagcttttagtttttatcacagaatattttgtttttcactatatgcctcaatgggttccacaaaatttattagtagattctacaaaaggagtgtttccaacctgatgaatcaaaaaaaaggtttaattctttcagatgagcccacaaatccgaaagcattttcacagatagcttgtttctagtttttaccatgggatatttgttatttcactataggactgcatggactccgaaatgtctcctcgtagatcctacagaaagagtgtttccaaactactgaattaaaacaaatgtttaaatgtgtgacataatttcacatatcacaaagcattttcacagacagcttgtttgtagtttttatcacaggattttcagtttttcactataggcctcaatgtgctttgaaatgtctcttcttagattctgcaaaaaacatgcttccaacctgctgaatcaaaacaaaggtttactctgtgagataaatacacacattctaaagccttttgacagacagcttgcatgaagtttttatcaggggatattatgtttttctcaatgggtatcaaagggctgccaaatgtcccttcacagattctacaaaaaaagtcttaaaaactgctgaatcagaacaaagatttagcttcataagatgaatccagaaatcgcaaatcatttcactgaaggcttgtttctagtttttatcacaagataatcagttttttactataggcctcaatttgctcaaaaatgttccctcgtagattctagaaagaaagtgtttctgacctgctgaatctcaggaaaggctaactctgtgagatgagatcagacatcagaaagcattttcatacatagcttctttgtagtttttatcccaggatattcagtttttcactatatgcctcaaaaaattttgaaatgttccctcatagacagtacaaaattatgagaggacatttcaaatgaggggacatttcaaaagattgtacaaatctatgaggggacattccaaatgaggggacatttcaaaagagtgtatccaaccttctgaatcaaaacaaatgtttaactctatgtaataaatccacacatcacaaagcattttcaccatatcccccaaaaaggaaactcttgttctcctactcctattggagggctgcatgattcctataggatgaaaagcaggcagccatggctggcttttgcctggtaatctaggctctgtttcatttcatctgcacgtcctttctcatagtggagaggctctttcattgggctgttgctgggtgggactgcctctcgccacagttctattggctgccggggatttcagggagcaaaagggacttcgggtaggcaggccatgctccaggttgtgtattatgatctcgttgtggtgcctgaggttgtttgcactttgcaggagacttttgggtcctctgacaggaatccttgaacgttgcttggactccagcacaagtcagctcgttctctcatgcaaaccttgattttcctttgttttcatgggggcggggggggtcaacagtgcccctcaacagcactgctggacacccttttcatgcttgcaatcgccacagacggcctctgagacaatgtctcaacctcctctgcacccgtgagaggccagttcaaggtgtgagaacactgctacgccttggacttgcctttgccgtagttcctgcctttcccagagagcccctgcgaggcccaggatgaagggaggcaatgaggtcaaaggcccggccatctttcgctgacacccgcctctggggtctcaggtatgagttcatcacccaaagacccctcaacaggtcaccagactatattccaatccccatgggacccgattcctgaacgcagcctctttcgggaagggagtcagaagagcagtttccagagaccaactcacactctcgaaatgcctccttctccagcgggacccgaccttggagacggtccgagggggccctaaggtcgagacttttagggtcctgcagtggattatcgtaggcagcctttttcctgataccagaccagctctgcctgtaccattttcctctgtttaagcaggctaacagctctgacagctgggcgcccgagactgcctcgctaaagcgcatgcgctagtctcagggcgccaggcctgagctgtaaattctggctagcgtcacaatgaatgccaccgtcacctagcgacaaatccctgcggcttggcggagacagagaactttgtggaggtgcctaggcggtggactctcgcctgtcttctctgtgggatccacgggatagtcccatgatcctaggagagggcagacgtgagccagcctgaagaaacgccaagcaggagccccaggaataaaccgcaaaatccctaaggatccaaaaggatctgcaggatgcctcaggcctgcctagtcatcgtaggggtaagtctttttgaaacttgccccactgtgatttttagatacagcccacctgtgttcctcagggttgctctctcttaggtggggtttccttcagaaacatgcagcctcagaagctgccggtctgtgtgttctgtgggagtgttacaagtgttggaagtctgcgtgtgtgtgtgtgtgtatgtgcctgtaagtgtagtcgacttaaaggaatgtggctaatgcactgcagcgcttctttttttttgagtctcccaaccttatgttgtcctgtctgtgtggctctgcttggtctgcgcggctcggtgctctttatctttctgtggatcatgaatccgcagtgaattcggaggctggctgagaccggcctgggtcaaaatcacctccactgcaaaaaaaaaaaaaaaaaaaaaaaaaaaaaaagatgttcttctagaaagaacaggagcacaccacacccaagaaaggacatctcccagtgttttaccgtcttgcgtccaagtcagggaaagacactagcagttctgtccgcagggcagaatttacatcgaattcagttcccagccgagcaggtacttcccgtcgtgagggggcactcctccatcatcttcggatttcattcagggacagaaagtgtgagcagcaataaggtcagataggggagaggatacaatctgttgtggggtgaatgaggtcccacacctctacctgcaaaaaaggtgaagacagatgaaggtgcttccagctgcatcccctcagtcccttaattgcacaaccagtacacccatggcccggtgttcaggtgggaaaactccaaggtgcagggaacatttggagtgcaaactgaggccatcctgacaaactcccaatttgggggcttttatacctagagccaaatggaagtgtgatgggttgatgctgggtgggatgtggccaccgcacttgcctcttcttttgctgacttccatgttcctcatcggcctagggtttcctggggctggctcaacgtcttacacactaaatgtttcacagttcacagaggacgatcctcatgggaatccattacatgagtgttttcttctaaacgctgtcacgttttaatgactggcagctgttataattttaaaaccgtaaattcccattacattcaccaacaaggaaactcttgttctcccacttctattgaagggctgcatgattcctataggatgagtagcaggcagccatgtctggcttttgcctggtaatctaggctctgtttcatctcatctgcacgtcctttctcattgtggaggttctttcattgggctgttgctaggtgggactgcctctcgccataaatcttttggctgcgagggatttcaggcagcaaaagggacttcaggtaatcaggctgccctccaggttgtgggtcgtggtctccttttggggctgaggttgtttgcactttgcaggagggttttgggttttctgacaggaagctttgaacattggttggactccagcgcaagtcagctcgttctctcaggcaagccttgatttttgttggctttcatggggggtcaacagtgcccgtccacagcactgctgggcacccttttcaggcttgcaatcaccacagacaacctctgagacaatgtctcaacctcatctgcagccatgagaggccagttcgaagtgtgagaacactgctctaccttggacttgcatttgtcgcggtttctgcctttcccagagatcctctgcgaggcccgggatgaagtaaggcagtgaggccaagggcccggccatcttttgctgacacccgcctctggggtctcagtttagattccatcacccaaagacccctcaacaactcaccagactatattccaatccccatgggacccgattcctgcaaacagcctctttcaggaagggagtcagaagagcagtttccagcaaccaactcacactcttgaaacgcctcctcctccagcgggacccgacaacagagacgacccgagggggccctaaggtcaagacttttagggtcccgcaatgggttatggaaggcagcctttctcccgataccaggccgtctctgcctgtaccattttcttctgcttgggcaggctgacagctctgacagccgggcgccccggtccgcctcgctaatgcgcatgcgctagtttcagggcgccaggcctgagctgtgagctctggctagcatcacaatgaatgccactgttacctaatgacaaatccctgcggcttagctgggaaggagaccaccgtggaggtgcaaaggcggtggactctcgcctgtcttctccgtgggatccacaggatagtccgaggatcctaggagagggcagatgtgagcgagcctgaagaaacgtcaggcagagccccaggagtaaaccgcgaaatccctagggatccaaaaggatctgaaggatgcctcaggcctgtctagtcgttgtaggggtgagtctttttgaaacttgcccactttgatttctaggtatagccccctgttttccgcggggttgctgtctcccaggtggggcttccttcagaatcactcagcctcagaagctgccgggctgtgtgtttctgagggagtgttgcaagtgttggatgtctgcgtgtgtgtgtggctttgtgtatgtgtgtacgtgtgtgtgtgcgcgcctgtaagtggagtcggcttaaagaaatgcggctaactcactacagatttttcccccacctttttgtggcctgtctgtgtggctttgtttgggctgtgggactctgtgtcctttgtgtttccgtggttcctgaatccgcgatgaattgggaggctggctgagacccgccggggtttaagtcacctccctctgcaaagaagccactcatctagaaagaaaaggaccacaccacacccaagaacagacaactcccagtgcttcattatcctgtggccatcccagagaaagaccctagcagtcctgtccacagggctccttgaatttacctcggattgggtttccagccaagcaggtgcctcccatcgtgaggaggacactgctcccttgtattgggattacatttagggatggagagtgtgagcagcaataaggtcaggtaggggagaggatataatctggtgaggtgtggatggggtcctgcaccttcacctgcaaaaaagatgcagacagatgacacagaaggtgcttccaagtccatcctcgcattcccttcattacacaggcagtccacacgtagctcagtgcccagttgggagtactccaacgtgcagggaacagttggagcacaaacttgggccattctggtcagctcccaatttgggctttcattcctgaagccacatgagattgggatggatggatgctgggtgggatgtggcctctgcactggcctcctcttttcctcactttcacttcctttctcagggtcttggcttgttctttagcccaaagggagtggggtggacagattacctctgaaccttgggtgcctttgatttctttctttgtatttgatgtcattacgatgaacattgatgcctgctatgtgccaggactgagtcccggattcccagaggaaggaggcaccattcccctgagcctgctaatgggtcttccatccacccttctcattataaggcagagttcaggttttgagaccaggaaaacgtgaatttgactccactgggtcacctgccagctgctgacagccacttaattcctccaggcccaacatccctgtgtgtaagcacaatacacaattagggttgctgtcagccttatgcaaggggaggcttggaagtgcttggcagcagcaggtggtccacccagactgtctgggtaggcctcggtctgcttccctccaggtctgtgccaccttcactcaggctcctgcagaggcagtctgtcaccttgtgaccaggctagaaaacagcacctggcaggagggcatggggactaggcgggtccctgtctggagcccctgaaagtcggccaggcagcatctctgggatgggtggctggatgccagtgctcttgtcctggcatccctctgtttcctgcataggctcgtggtggcagacttccaggcctctccacattctctgtcctggtgatggtgggagtgtctccccctctgaaaggtgcccctggaggttgggaaatggccatgccctttgaacctcccttctggcccagggtctggctcagacagagtgcacagagtgtgtgttgaggagggtagaggagtggcagccctttacctatgagccagtgctctgcaggtctacccaagggccaacatcccaggggccaggccctaaggtgaacgtggcatcccaggtcccagcatcttctgagaagacatcatcccagtaccagggtccctgttggatagtgcctctgcccatctctcctctggctcccagcaggttcatggttgcagtggcctgtgcaggaggggtgcaggtgatggggccagggacttttgcaggaaggaactaggacattggccaaagaggctgctccctgaccccaattgtgtccctaatttactatgtgacctccacaagtcattcagcatctctggtcctgttcccccccccacaactatgtgatgggcacaacaataccacagtccctgtgactgtgttttattcaggagtcagctgtgggcctccctgacactccatccccaacaaagtccagtgtcaggagttagttggacctccacctcgatcttatattttccagcagcattttgggaaggaatatcctgaaaggtgagcctgcctgttatctcctcagagggttcaggaaaagccggccctctctatccccttttctcaccatgatcctccaggtctgttcacctaatcactaggcatgaactaattgaacatctgccaagacccaggtgagcttttgcatctagagagaactaagacacagccatggtcctgggggtctcaccctcttagatgggaggccagcaggagaggacatgtgggtcgggttcaagagtggagtaggaagttgcgagtggctagtgcccacctgggcatggtctcatgggcccttgccaggaatgtgcatgccatcctgtggcctttgtaaggcttttagcagagaagggagtgggattgagaaaaaaatccccatggccagggctgcaagaatggctaaggtccttggtggtaccatgggcatgtggcaatgaccggaggtttgagaagtagagtaggcagggtctggtggtcgaggggcatctaggggaaatcagaccgagttctagcttcccagtttgcactcatgggcagacagtggtgattttactgaggggagatgacctgaggaagagtaggatggaggaaacaccgggcctgcctgaaggtagatgccagacaaagggaggaaaagagaagcctgagaggaagcagcaggtacagatcaaggaggagaagcacaagagtgctggcccaaagggcaagaagtgtccagaagaagggggctacagaaaggtcaagttagataaaggccatagtacacttatccaatgtggccaccagaaggccagctggtcaagggtgttgctgaaggcagaggacagtgggtcaggagtgaaggtgatgatgtggatcgagagtgtagacaacaggcagaaggggagagagatggtgtggatagagggggtgtagggtcatagatggaaatatccccaagtttaggtggatgggcaggagatcattgctgagaagggatctcataagaaagtagaggtggagcagaacagagggggcaacgatgtgagggtggcagtgacacagggtcattggggagtgtgtggggacacctgtctgttgggcatcggctcatggcttagggcaggctactgggcaagcccacagacccctagaagagaggagctcctgccatgtatggcgcagttttgtcattcaccatgcactctaatttcacatactgagtacttggtatgtactggtcactgtgttggacacgggggacataaaatatggtaagacacagtcccaaaggggctaacagtactgtggcctcttactcaaaggcttgcacccagggttaagcttctaacaagttggaaggcagacataggcacctccatttgccttgagtacaaacagatgttcagagaggtttagtgactggtcaaaggtcacgctgccaggaaatggctgtgtccaggacagttgcaggtctcctgcccataaaacccacccaggccaccaggttcagtttcagccaggtggccttcagggttgaccaccctgttcgactcggcaagaagaatacaagccaaaggcaagcacgtactcattcttctgagcatcctctgtgtgcccatccctgttgtgggcatgggcggcagggaaggagacatgaattccaaatcgtgaccttgccttctgcagctgagggtgtagttggagaatttgatgtcccaggagagggatgtctcctgttccatggctgcctaggagagggcagaaagcaagccctcttgaaggagagagagaggggtaagggggaggtaagcagggacaactcttcccctccctcaaaggaggccactcaggaatcccagggaagccagacaaaagcctgtggaataaaggggcctctgagcctcctccccactgctgccatcctgactcagggatttcagggtgcagtcatcattcccacccccaaaggagaaagcccaggccggtggagcctggctgctgcaacttcttatacaagcagctctggaggccccatatctgagctggcagctccattagagggaggggtgggcattagtatggaatgccagcctagatggatggtcagtgccaggttctggggcataggaaagtccaggatcatgaccaggggtagctgatcaccaggaatgtagttgggactccatgcccgaatgctagggagactcagagctggatctgggccacaaagtgaggggacagtggctgttggtttatattgaggggaaaatggggccgacaggactaaggccctggggctgaagggcatagagctcttgctaaaatttgggaggctctgtttaaaggaaactagtgttgatagaatttccagagctgctgcctgggccaggtaagacccgcaggacccttctgtccaggttaggctcctgtaggtgcctaccctatctcctcaccttctcctagctagaggtcccctatgaggcatgaagctggtggggcagaggcccctgtcagggccttcatgtctgcctgggggctggaccacctggccggaaaaaggaagccgaggtagcagaagggcctgcctgaagatcctctgagtcttcctcctccttttctactccttggcccaggtggttgtataaattactattcacccctataaaaattgtttaactccatcacaaatatttggataatagggggatatctcaatctaattactgttagcattttggtttcttttcatttattctccttcctatgtgtgtgtcttggggagttcccataggggcatcatagagtactgattattgtgcattctgctttttcacttaccgtattcacctagtcagccagtgtcagctgctgtaccaggcactaggaaccaataaaaaagtgtgattcctacactcaggtagcttattgtccaggacagattggccatcaaatccagttaggatgtggtatgcagatatgatatcatatggttatgatatgatatggtacatcttcaaggagctgtgtcagggacatgatggagaaaccactctcccaggatcttgtcagcaagagggaaatccaggagtgcttcccagaggaggaaggtgttgacagaggtgaattctaaaggtttctacagttccttctcatgaaaccgtctggacctggtgcttttttcagtggcagatttttttatcatcagtggtaattaagtttctactcattatctagttcattaggggcactttatattttactaggaaagcattcattttctccaaatgtgtaaactctccacttttaaaatttattatgaatttatttgtggccaaacaaatgatttttctaagattttcatagacgttgaaaaaatgtatattttctatttaagggatataaggtcccatatataccaaatcaagtttttggttattcaagctgtcacttcttttgtatcctttgggggaggaggcttttactgtagttctaacagagatttagccttccactcaaattttctctataaatctcttcttttactagtttttgctttttatatttactatgatgtggggagaatgcagattttgagtgttctttataattttctctataaatctcatcttttactagattttgctttttgtatttactgtgatgctgtcgggagcatgcagatttcgagtgttctctcattatgaattgtgcccatcattacatggtgtccctctttatcccatttcagtgcttaaccttaaattccacccttctattattattatggccactctttattttactttagcttttgcactttcctggtatctcttggcattcttttattttccaccattatcattgtttaagtgtttttcttgtatatatacatcactgggtttttttgttggtggtggtgttgattgagacagggtcttgttctgttgccctggctggagtgcagtggcaacatcacagcttgcttcagcattgacctcctagtttgaggtgatcctcccacctcagcctttacagtagctgggactacaggcatgcaccattacacccagctaattttttggttttttttttttttttttttttttttggagagatggggatctcaccatattgcccagttatcactttatttttaaacccaggctgacctttgtcttttaatgggaattcatctgttcacatttcattaaacaattgatctactgtagttggttttatttcttttggcttattttacatttattggtttaccttgtgggttttttcctctggttattgatcactctggttattaatttcctttttcttcccttgttactctttccatttcattactggcatctaccccttctctggagttcctaatcaaacacatattctttagcatgtgattccatggggattttttttctcagcactgtcatctggagctccaatctgttggtctataagcttaggtctttctttctgcttctgtaaatctatttgttgtttgatttgattgttgtttttgttgttgtttattttctctcttcccctttctcctttcttttctcttcctttttcccttttctttcccttctcttctctcttctcttcagtctcttctcttcttctctcttctctccctcccctctcctccccttttctcccttctgtcatcttcttttcttttctttcacaggatctcagtctgtcacccaggctggagtgcagtagtgcaatcatagctcattgcagcctcaacctcccagactcaagtgtttctcccaactcagcctcctcagtagctgggactacaagtgcatgcaacaacacttggctaatttttgtattttttgtagagacagggtctcactatgttacccaggttagtctcaaactcctggggtcaagcgatccacccacctcagcctcccaaagtgttgggattacaggcatgagtctccatgaccagctcatttaatcttagtttgtgtgttaatcatttaaccttcatcattccccaaatctctctttaaaaataccctatagatatgtaaatcactgtaactcttatgtctcttcaacttttttatataaagtgacaactcaaaatacacttttccatttaatgttatttaatacaaaccattctattttttatgctagtatctccatttggccataaaacaatatatctagaaataaagtgtgagcttcaacagaaacaatgatctactgtttctatcaacttttgactatctataatcccttcgcttcccatctatcttcctcaaacaaattgaacttaattgtcaacttgaaatttctagagcttatgcaacttcaactcatttgtctttcccttgctttattcaactctactgccaaaattacaacctcggttaaatgcaactgtctgtgtgtctaatccttgccagcacccatgcagctgaacatgcccaaaagaacaatataacaatgattttcaacattttatatccaggccagaactctcctctgagtttcagatttatatatttaaatgcttacttaacatctccaattaactatttaatggaaatcccaaaattaatatatccacaactgtcaaattcttcacctacatcttctcccattttacaaaaattccacttttttccaatgaacatttaccgtattcatcattttgctctaatgtttcctcaaagtggtgcctaccttaatcgtattactaagtttttctaagcacttcatttttctgccctgctttgttttcctccttagaaccacctgatgcactgtatattttactaatacacagtttgtttctctcacctgctagaatataaattatataagaccagcgattttttatatcatgtttactttccaatgccataccaagatcagtacccgacactgaaacaaaggtagattattcagttttttaaaatgtgtcctgtggattactagaactgcaaaactcacttcaataagtctacgacacttaaaaaatacattcatgacaccttatcttcctggggaattacagtgatttctagtttttaaaagtaagaagacataaacttcagtttgaaaccaggactcatcatcccatagttagagctggtcttctttgtgtgctcagggactacagagaggtccggggtgttggcctcagcctcttggacaagggaagtgggcaccctatgagctcaggatccctgtccctagcctggataatggcagaatctggctcagccaggtccctggcctgcacaaagccagtggcaccaggtgaacgtgcccagctcagtgactgcctggagcaggtgtggggcagccagacccagtgggtgtgggcttgggagcctagccgcagaggatgagcaggacaagggcagtcagacagcccttagaaggcctccacccctgagctgcagaaagagatcccctcatccagctcctccccaggggcccactctggatcaacaggaaaatgtagcccctgatgtggttgtgcataactggacagatgggagacatggagctgaaggccatgtggataaccgcctgctggtatcccagttgacatcccagtaccacatatcgctgaaacccaggtcaccacatcaccaatggtcaagtcgatgtgaactgttgattgttgacgagtcccaggatcttttctgctcttgagcctgaccatgaggtagtagatgccaaagtcaggcaagcattgccaggcctgatggaggcacagctgggcctggtcggcaagagccaagccacattctaggggcttccaggatccgtgggatgagctgcttggccttgaacttttgtggaagggcagggtggggggtgtggagggagtaccaagaccacagaggctgaggcccctgacaagggcgccactgccctgggggtggttgccgaacccggtgcctgtctgctggaaggctacacctcgctggcggctgttccctgcatggtgcagcccctcctgggaagccagtggcagcccctgcagcatgcacccagctgctcctgctccgcaggtgggggtcgcttgcctttggtgagttggatgcagaactcgcagccagaggcgctaacaccagaaatgccctcacagcccttgaggttgagctgccgagggtgtggggctggtgtccactggggcgtggcctggctctcatggcaggattgcatgggttccttgaacagctcccagtgctggcctcagcccttcagggtcagcttctggggctgggagatttgaggacacaccttgacttctgtgacaaggtgtgtcacagaacacgggcttccagcccatctgtggatatctagccctccagcttctccaagctgctgagggctgcgtccaggccatccagccaggtatccacagcccatctcccctctctgagacagcctgattccataggattgcagagatgagacaccatcaacccctcctagatgcagcccacccctccagcagcagatctcactgagcagctcgcacagcggggtccaagccgcagaagtcttggggctgaaagtgcagccagagtcgcctggccctggcaccccgttaaatgaggcaccgcaggtaccagagcccgctgtgcagcagggattcgtccagcgggcgttgggccctggcgggcgagggagggtcgggcggcgtcggtcactggctcggcaggtggtcgcaggcctggattggccactgtcccagaagtgagccagcctccccggaagagcgctggagcgaagctgcccgctaggaccaccttggtcaggttgcacacctcctcgtccggttccttctagtctcaggagctggagtggggctggaggcaagtgagccccacctgcggggcaggagcagctgagtgcatgctgcaggggctgtcactggcttcccaggaggggctgaacagtgcagggaacagctgtcagcgaggtgcaggccacccttggcctttcaggagacaggcgcgggactcgggcaaccacccccagggccttggctcctccatcaggggcctcagctgctgtggccttggtgctcaggaactggagtggggccagatccgggacgccgggcactgtggaggctgtaggtggcggctgcggcccagaagcactgacgaaagcaccttgacagatcaagtcaaaatgttactgagggccgggcgcgggggcgcatgcctgtaatcccagcactttgggaggccgaggcgggcggatcacgaggtcaggagatcgagaccatcctggctaacacggtgaaaccccgtctccactaaaaatacgaaaaaattagccaggcgccatgctgggcgcctgtagtcccagctactcgggaggctgaggcaggagaatggcgtgaacccgggaggcagagtgagccgagattgtgccactgcagtctggcctgggcgaaagagcaagactccatctcaaaaaaaaaaaaaaagttattgagaaggccagttcattctctaggatgccagtggcaaacaaacatgaggatgaccagggagacgaggattttgagtgcttactttataaagtgtctataatatctgcagcagaagaatttaatggcaagttgttcagaagataagcctggaaatcttaaatgtcctatactcatttttaattatattgtatgttacatactctttggggcaagaatgatggagattatggaagtggaataagggctttccctctctgtttgcttcagaccacttctttgttaccattatcacaattggtacagttagctggatgttgtgttaaacacattaaagacatgttattggatgcgcattttaaccatatgggataggttttattaacagggtgtgaatatggctcaaacaatttccccagagtacgtaatggattagccaacactagtctgttttcctcccaagccctcttgactattattacatattcttcccatgagagaccaggagatgcctaaagaaagggatcgagggagcagaaggcgttttgtgaggaggagatatctgaatggtacttgagtataagttgctacacggttgtgtgctatgacgtctatccacaaagaacccagtttacccaataaaaccttcaaccaaccttcatatcttaatttttctttgaagtattcctctgagtgttgaagagaagtatgaaaatttgctccacagtaaactgcagagataaacagagatggctatgaaaatactacaactattattaaggaagacggctatttgccttttagtataaattgagtcaatgagatgcataaatattatttccaatatctgtgaatatttgcctaagacataatttattattattttcatttttaatttgtagatactattgtacatattgtgtacaatatgatgttttaaagtatatatattgtggaatgattaaatctagctaatgaacatatgcattgccttacatacaatttttgtgttgagaatacaacaattttaaatatttgtccaattcgcatttggaaaatacaattaaaataagcttaaaatgcctataattcacaatgcagtcataaaaattaaactgatgaaacacactaaagtcatttaaatgtatccttactcattgttcttgatgatatagtaaagcatcatcaaaatatagtagtctctattgttttagaatttgattttttagatctggtcataattatgctgtatagataaaactgtgtgttctaaacggatttgaagtcagaaacttgcactgccaagacaacactgtgtcttatcagctctgcctcaatttgcaaatcacgtaagctttctgaactccattttattcacttgggaagtgggaccaatacactaaatatttcagttaatacaaagtagaatacaaaaagaatcacactctagttccattccacatgagcacttcagctattttcctccagaaatcacctgtacaccataggaaagtaaattcatacccacctagttaacagtgtgagaatgtaagtttaaagcatgtttgactaaggaaacttaatcataataaaatggtttaatttccctgagcatgaaatattctccacaagaaatggcatgctatgtttaattggttctgggaatgattatccaatattagtcactttcatattagtgtcccctagagtggaaaataaataagatagtgattgcacttctgcatgtccatcttctgccaagacattttgctaatgtgcagtgtctgcaacttcccatttcttggctaagttcaagctttgttagtttagtgcttaggaaagcctcatgttctttcagaaattcttttgctctcattactttttgtgatattatggacaataatttgccttgggaacatgacaactgattccaacagttgccaatgttggggagggaggtgtcaaaaggtaggctttttcaatgtcaattttaacccagcagcaatttctgcagttgcaaataattctattttctttctggtcacttaagttctgtcaaattaaattagtgttcaaaactcatagcacagttttgcttttttattactacatctgcaatttgattagtgtgatatattttcatatatgaatgaatatcaattaaaggcaatgaacatttataggtaactttttcagccacagaggttagtaattttaacatgtaaaccatctgaattcatattgcaaccatatttttgtaatataagaaaatgtagattaaataagttttattagtattttaaatgtaataaaattattttctgctggctgcagtggctcacgcctgtaatcccaacaccttgagatgccaaggtgggtggatcacgtgaggtcactagttcaaaaccagccttgccaacatggcaaaatgccgtctctactaaaaatacaaaattagccatgcgtggtggcgcatgcctgtaatcccagcttcctgggaggctgaggcaggagaatagcttgaacccaggaggcagaggttgcagtgagccgagatcgtgccactgcactccagcctggtcaacaagaatgaaactcctttgtaaaagtattttcttaaaatattaaaatatagtttaatgtttcattaatatcatatgcccattaaaatgttgtattaaataactataatattactgagaataacttatgtttcagacatttcacttacattatttaaatcagacttcctaataacccacgtataaaccttggtatgaagtaactgatcctgagagatgtaaattatcttcccaaattcatgcatttatgaagtttatcaactgagttttctgacactatatgtaacatttttttctccatgccacgttggttcctggcattccaaagctcttgaagaacattgaaagaaaccaatggccttcatccgcatttcaaccaacaatgctacaatcacctttgttcacagtcctgtcttcatacaaaaagaaatgtttccattagtttccagcatcatctcacataattattattttggtttagaacactaatccactctcagaatttctcaaaaatacattaagttgctaacaatagtcagcacgttgcacaatagatctcttgaaattttactccttctctctgactgtagttgtgtatcctttgaccaacatctaccaaagtccattcccaaccacattagctgctggcaaaaaaaacattttactctctgcttgttaacttttttagattccacatatgaatgagactatgtgataattgtcttcctggcctagctcataatattctccaggttcatccatgttttcacaaacaacaggatttccttcttttctgtggctgaatgtatttcattgtatgtatatgccacattttctctacccatccccccgtcgatggacacaagttgattccatatcatgactactgtgaataatactgcaataaacatgggagtgcagatatctgttccatatactgattttatatcctttggataggtagatacccagcagtgggatcactggatcatatagtagttcaattaaaaaatttctggagaaccatagtacttagcggcctaatacttaatatttaatacatagagactgtactaatttattaggttagtgcaaaagtaattgaagtttttgccattgaatgtaatggcaaaactgcaattacttttacacgaaattaatatattcccaccaatagtgtacaagggttcccttatctccataccctgatcaacacgtttaattcttgtatttttgataataaccattataataggtgtgagatgacagcagagtggagctttagtttgcatttccataataattagtgatgttgaacattttttgcataagcctacttggccatttgtatgtcttcttttgagaaatgtctgctcagatcttttgcttatattttaatcagttcatttgccttcttgctattgagttgtttgaatttcttatatattttggatgttaattaccacaaaattcataacaatataaggtaatacatatgctaattagctagattcagtcacctcaccatgtaaatatacctcagaatatcatgtacaaaataaatacataaaattttatccttcaattaagaaattaaaataaaatgaaattttcagcatgatagacattcaaatatatgaatcacgtcatcccaacctctctttatcattttcagtagttacgggtgaaatctgagtcagggctgatgttcctagttccctactattatattcttaatacactgcagtttctcaatcatccttattaaagcagttaccaaaatttaaaaattaattttgagtgtactatgatcatctctggaaaattataatttgaagaagtgcttctatgaatgggataaaatatttcatttttttcagcattccacatttttgactcattgactcagctaaaccacataaatcttcacttttttctattttatatatcataatgcctatctttcagctgtgaaaaattatcaactatatttgtttattaactttgggaatatgaaattcagatcatgatcttctataaataaaatttagaagttttttttctaaccgaagcattcagacttgagcaaatgacaaatgtagaatattttaagtgttgacaaatatatacatataatatcaatgtttttgtgtttcgagtttctaagcaatatttgctagctgataaacttattttttatttactaataagaaataatttggattgcagaaatcaagatactctccttgcatgacattaagattaatagataaatgttatcacacctacaggcacatatgacaccaccagaactttacctaaatgattgttttccaacttatgtaattgtggttgtttataaacgtcttgtttattgttaatctttattataaacatcttgtttattattgaccttgtttataaactatctttactaattaggaaacttttttttctcttttctttttttttttcagagacaaggtctggctctgtcacccaagctggagtacagtggcaccagctccactcactgtaacctttgcctcccaagttgaagtgattcctgtgcctcagcctcccaagtagctgggactacaggcacgcaccagcacacgtggctaatttttgtatttttaatagagatagggttttgttatattactcaggctggtcttgaactcctgggctcaagtgatcaactattcctggcctcccaaagtgctgggattacaggcatgagccactgtccctagcctctgttttctttattgctttatttatctggttttgagttgggagatgatattaaacaagagttataattttccaaaaattgaaataaaaataattttaggctagaggaaaatgcaaacaatagcaacattaggatctattagcttatttgaattttgtaataaataaagatttgatataatgggaaatttaatatacttaatatgtaagtacactctcaattcttgaaggaaataataaaactgtatcaacatagaaagatataaaaaaatgctaagttgtcacaaaaaaaagaaattcacaaaaaaagaaattccaaagcagaagtcctggtatgttactattccagacaaatctgatatgagaaagcactaaagataattgaaacattaatttaataattaattaattaaaatagtacagtcctggatgtcttttttgtgctttctttaatttctttccagctatatataaatgtgtcttggtatgaatttaagtgcctgggaatgaatagtactgtcccccaggataataagttattagcaaattaataccttgcttctgttagttgtcaacatgttgcaagtaaacattgttgataggcactgtggatctactaagggtaagatatcatcctttcacaaaaggatagctattaaacctgactgtaggtaaagttaaattgcaactaaacatatgtagacatatactaagattttaaacattacacaatatttctgaccaataaaatataaactagagtctaaactgtttggttaagaatttcattgctagagtacccttacaagttctaactgaatttccaaaaatctaacattttgttctcaataaaataaaatgtgtttaataaatatgaagcaaaaaacaaaatcctaaacaaaagcaaacactgttgatcagtcaatttaacatggaatattattgctattatttttattgaccaataatttatttcctgacttttcttctcagatatggacactattgatgggagcggctggccatctggagtggcagttgccatcatgccagtagcgcttgggccgcatgggcagtgttgtcaggagcagcagcaggagcagcagtggcggtggtaggaccccgttccctgtgtccccaaggcatctgactgcgccgccgccccctaatggctgggcaggacccactgccaggtgcagaccctccatggcggcctcaatttcgcttcctaccacatctgggagcccatcagcgctggcagccgggtcttgcaggattggccccaggagcatcaggttcatttgtgcggcattagccagggcccccatgccacctgcacctcgcccatgcactactgcagggaaaacgcagagaggagtcacggccaaggctgcacactctatggagccagtggcagctggggacaagtgggagcccagccccttccaagttgccagggcaggaactccccaggcgcaactgcagctgcccaaggagggtctgcgacccaggcactcctgtgctcttgggagccaggagaaggcaggagccccaccctcccaggcacagctggagcctttcaagccacagctgcagacccaggcacctctgcactcttggggcctgggaaggcccccgtgaccacacaggctcggaagtgcctgcccccactgtctgggttctcctcgctgtcagcacctgctccaatcttcgagcaaagttgaggtcgagcacactatattgtgaccaatataaaatagatataaaaatacctcttacacttaaatccaggcattgccatttgaatgacttaagaatatgcagctaaggtgcttttaaaaatacaagctagtgattatactgaatttgtaaatcacgtaggatagtgagtcattttagaatattaattatttcagtccataaacctggatgtctttccttttttgtgttttctttaatttctttcattgatgtttgtaatttttgttatagaaatcatttacttcctcggttaagtttatttctaagtacatttttgtagctattgtaaaagaaatagcttccttaattttttttctgctagtttactatcaacatatagaaatgctactgttttttgtatgttgattttatatcctgcagctttattaaattcatttatcactctaagaagttttaggtagagaccttagtttcttccgtgtatgagatcacattgtctgcaaacaaggataatttgactgtctcctttccaattcagatgccctttatttctttctctaacctaattgccctggctaagactttcactatgtgaaatatgattggtgaaagtgggcctccttttcttgctccagttttcatggtaacatttttcaccttttccacgttcagtatgatcttagctgtagggttgtctttacgcccttttgtgttgaggcatatgttttccacactaaattgtttagaggcttttgtcatgtaagaacgtttaattttgccaaatgctttcattgtgtttattgatttaatcatatggttttcaatatatatccaaaggaaagaaaatcaatatatcaaagccttacctgcacccccatgtttattacagcactattcacaatagccaagatatggaatcaacataagtgtccatcaacagatgaatggataaagaaaatgtgacatacatatataatggaatactattaagttataataaagaacaaaatcctgtcatttgtggcaacatgaatgcaactggagggcattatcttaggtgaaataagcctggcatagaaaaataaacaccacaggccaggcacggtggctcacgcctgtaatcccagcactttgggaggccgagacaggcggatcacgaggccaggagatcgacaccatcctggctaacacggtgaaaccccgtctctactaaaaatacaaaaaaaaattagccgggcgaggtggcgggcacctgtagtcccagctactccagaggctcagacaggagaatggcgtgaacccgagaggtggagcttacagtgagccaagatagcgccactgcagtccggcctgggcgaaagagcgagactccgtctcagaaaaaaaaaaaaaaaaaaaagagaaagaaacaccacataactacatgttctcatttacgtatggaagcttagatagtagagtattggttaccatatacgggaaagagaaaggggagtatcagaaaaatttggttaacacatacaaaattacagctggagagaaggaataagttatagttctctacagcactgcagggtgactgtagttaaagggaatttattgtgtgttttcaaataactagaagaaaagatttttagtattctcctgcaaagaaataataaatgatttaggtaatggatatgctaatgactctgacttgatcattacacattgcataaatatatcaaaatatcactctgtaacccataaacctgtacaattattacatgccaattaaaaataattttaaaagagaaaaaatgaaataaaagtaaaggtacagaatttaactactttttcttctatgaaaccaggaagagtgaatttattagttttctaaaataaaaaaaaatcaaaatgaccaaaaaagagcaatatccaagaaaaacaacacttagtaagaatacttagaaaacttgggcactgtatcaccctgttcctagataccaatttacagatgaccacttaaatagaagtttattccagttaattcatttataatcccagagttcaaaattatgttgtacctacaataaatgagataacacgtttaaattatatggtactctgcctaacacaggttaataactcaatacaggttagcaataagcttttagtgtagtagtcatagtactatttctcacattgcaattttcttcattcagagacatgaatacaactttcttcatgactcctttttcatcaagatacctcttcaaattattctatttctttcattcagtatattagctgtgtatatcgatactgcattttttttttttctgagatggaatctcattctgtcacccaggctggagtgcagtggcatgatctcggttcactgcaacctccaactaccaggttcaagcaattctcctgcctcagctccccaggcagctaggaccacaggtgcacaccaccatgcctcgctaatttttgtatttttagtagagtcagggtttcaccatgttgtccaagctggtctcaaactcctgatctcaggtgatccacccaccttggcctcccaaagtgctgggattacaggcgtaagccaccgcgcccagcctaatattgcattcttggattttgaacactgaatatctttttgaaaggttacacctctttaccaattggtgctttggaaattattttccttcaagtgttctaagagtctaatgaagaatgaaggtcatgttttatcacttttgtccttaaagatttcagacatgctgaggctgagcttggtggctcacacctgtaattccagcactttgggaggccgaggtgggcagatcacgaggtcagcagttgaagaccatcctagctaacacggtgaaaccccgtctctacaaaaaccacaaaaaaagtagccggtcttggtggcgggcgcctgtaatccagctacttgggaggctgaggcaggagaatggctgaacccaggaggcagaacttgcagtgagctgagatcgcgccactgcactccagcctgggtgacagagccagactccgtctcaaaaaaaaaaaaaaaaaaaaaaaaagatttcagacatgctgaaactgaatgaagtatcattcgctaccagttagattagttctttctagttgtaggagtggatacatctttaatggtatattttgggttattgccttatttttgatgccatattctgtaaataattttttaaacctggcaaaactcggtcagcatagatttgtcaactttggtgttatattgtgtttgcttttaaaaactgcttttgaggccgggcatggtggctcttgcctgtaatcccagcactttgggaggccaaggtgggcggattacctgagatcaggagttcaagactagcctggccaacatggcgaaaccccatttctactaaaaacacaaaattagccaggcatgttgatgcatgcttgtagtcctagctactcgggaggctgaggcaagagaatcgcctgaatcagggaggcaaaggtagcaaccattgcactccatcctaggtgataagagcgaaactctgtctcaaaaaaaaaaaactgcttttgaatagagttgtaaatacaattttttatgaaaaaagaaattatcaagtgcataagttcataatacaaaaacaaataaaattcgaggcacaagttagtactaaaaaaattatgttcatttttccctaatacaacatgttttttcccttcatgaacaatttgtgttttactgagaagactcattatttatggcagaagttagactacagatgaatatgtactttaaacactctcagtagctttcttaattttacatatgctgctttatgcttctgtttattttcatttttccaatgtccatattctagtaaatttgaatattttaattcaagtttattgaatttaatatttaatattgcttgtataatttagtatttttaagactcaaaaaggtttatgaaaaaaagaaaaagagatcaacgtgttgctaatcatttaaagattattttaaaatctttgacctttatatgttaatgaataaaatgttagtagctattagtataaaataatttatgtcttttggacttagcatccagcatttctttttttaataaataaataattattctcctgtaatatattatgtttatctgggttttgaaaaatgatgtttcctaatatgagaaagccatttacatgtttaaatctacaaaggcaaatgaaatggtactaaattatttacataataacgtttagatggtgacccttataacattatttgtatacttcatacagagttgggaatatgcaatcctagaatatttctgggggcaaacccttcagtttgatgaacaaaacaagacttttaaataaaattaaacttttaaattacccaggttatggggccttttaattcaatggatatggagcataatgaattatccccttttcattgggtaataagttctcattcttaacttataatactcaaaataccctttaatttttaatttgtgattaaccatatcattatccctaggtattttagcttctatcttgaattctataataattttgaaacaggagaaagtattctttattaccatatgtgttaaacatcatggttttcaaatttaactgcaaatgtgtctttttcattgcttcctgatgacgcccttcaccctatccatattgtcactatcaagtggtaattacttttcaggttcacatatttgtttttttggaaaatcttctctgtgtcttataaagaatatgattgtaggcattcaaaaaccagtgaaatacacataattagcctgtggcctaactcatttctttaagaaactacactaattttacccacatactgatatttttattgccgcattatttctggagaaaataaatactgctaacatgatgttggtaagagagtaaaaaagtcttttctcgaaaagtgctcattgtagtattaacatatagtgtcaatttctttataaattcctcatacacattttattcttagagaaataaaaatgctaaaagtgaaatgactttgtttattctgcatattataagccacccatcttggtaatttagggtctttatagttagggtaagttgtgtcataccgaggtaacaaaacaaaaggtattttgtctcttttgggcctttcattattcagttatactgtcactttggctttttttgtaggtcaacctattgacctcagtattctgaaataatatgtttactatcttttgatcagcatttaaaatattagatttattgttactcttctgcctttattgggctggatgaataattgtttctctcactccacaaaagccaagttgcagagaaaaacacatagacattcagttgcaaagcaaagaaacgactattttctgcaattttaaagtgtacattgaatgaattaaaccatctttttattttcttttttgctcacttgcaaatattaacaacatcaagtgtattattgtaatgttatctaggtaaaaatctcaacaagttttcataattaccatttttaaatatataaataggggacctaactttaatttttaatgtctgaggccatgtctgttatttcactctttaaactcagttcgtaatgcagacacttagtaaatactcaaaaaatatgtgctgaataaaaaaggttaaatatgtaatatgtacaaaatctactggaaaaaatgcaccaacaattttatttggtataccagtttattgtagaatctttattgcctttaaataataatatacttttccagtgtctacaatgacttgtaatatttgtacacatataaaataatatttccaaaaatgtaattcagtaaggaaatataccttctaaattctagatttataatttaggggttaaattataaaatcattaaataaaatacaaatgacatatagtcaaagatccccttggaaaaaaattaagtggcctctaaagtgatgtattcatatatataattttacaatcaccctcagtttgctgttcctctggcattagaacagattgttgttgtttatttgctttaacatcaaaggtaaatgtttttgttcaaggacatatgtaaaaataaatgcatatggtttacaatagcatcatatttagtgataagcacataggacatgagaccatccgaaataaatgcagaaccaaatctctcatgcatatgcactcaaccactcatgtttattgataaaatgctaagtggaaaaacctgaattttgtaaatttgtctcctttgcctttttaaatatacacacaatcaaactctttgtgacttagtaatgaataagtaatactccattgcatatgtaataaaatgtgtggcataaaatcaatattaggtataaaaaatctatggcaataaggttagaaggaatgtgccatagcagcgattatctcatagccaaaaatataggtatttttagtctctgatttttttcattgtctacactttctacgaataacacagataacttttgtaacattttattctaaatactttaacatgaaagatacatttaaaaatactcattccatatacacactgatttttaaaatatttattatgatttctcatggagtttaggaatattcaaaatctactaaaagttatcatgttttatgatagctctcacttgctttaaaaaaaaattcttgataatttacaagtacgcagtgggtatccacctggggcctagatatcctcttggggactgatgtcatcctggagcctgatgtccacctgggactggctatccacctgtggccagatatctacctatggccgaatatccatttgggacctgaagtccacctctggccgaggtgtccatctgggacgtgatgtccacccgacacctaggtatcaacttggggcttgatgtctacctgtcctcagactgtgggcccctgagggtcagggaccacgtggacattttcagtaccatatgctgggcccaccagggcacctggcacacaggactaatgctaagggcagagttgctgagtgaataaatgggaggatgtcaaatgccccttcctgcttctggccatctcataatgtggagatcattcataagaacaggaactgcatgacctcagcatgactctcccctggacccagatgcatgagaacagcacagtgggcaccaggaacacagaacactgtcctcccacccaccctgtagccagcatcagcactgcagcctcaggcaggagcatcacagaacaaaacagggaactgcatttaggattcctcaagtcagtggctctccaggttcccaggaggcagacgagcaggatctgcaggctccaagggcagtgagaaggacctcagcagtctctcttgtcccctctttgcctccagttcctggggtgtaaagttcactctcgaggtgtcctcaccacagccagggcagcaatttcccccaacttccaaatgaagttcgatcgtgttccgggacttttgacacagggtccagtgcctgggcacattctgtcctatcccaaatcctcatccacccaaactaccaagcctctgtctgctccgaaggacccccagagtgaatagctttttccaagtgtctcagcacacacggggtcattcataaaaaaccaaggtcaacaaacactatccaagcatgtggaaccctgtggtttcatgctctaagcacctcacattatatacaggagaaaacggaggcttcgtctcctgtagcccctgtctacactagggcaggtgggatggtcgtagttccaggtgcccacagaggtggactgcaggaccccagttctgtcctttcaaggctgtgctgggcaaggccctggcccaggcagaaccctgggaagcttgcggattctcctgcccatcctctaggcccttgtctgagcctttctctaaactcagcacattgaatagggcttgctggctacatgtaggtcaagggtgtaacccccatatctctaattcctcacagagttcttgctatattctccgacccaccctgttctcagaccttcagactcagagaggtgatggactactgcctggtaactctatctggatatctaagagcaaaccctacatagcaaattgtgccaacactctatatatccaccacccacaaacccatcccaatcataatgcccaaacagaaactaaatacttggattagtcccatatgcagaaaaaggcaaattataaacaaaatattgttattgggttagtggaaaattattgctgtttttgacattatttttaatggcaaaaaccgcaataacttttacaccaacccaataggagagtgtgaaatgaacaggtctagtttgttgtgcttttctattttctgtttgttcatatttgttgctttctgtgtatctttgagagtttggaggaatttgtgaaaggaaccaggataaacattttttcctgctatttgaagaccacgttttttatctatgttacatctctattaatagctttttcaaaattctgtttcatctgcataccttatgttcttaattagtgttgctactaatatcaaaaattattttctcattttaatattttgtcttctgttgtttcttagtttgtttcttaaatttgttgtgctttttgtttacttgtatgctttttctaggttttcagaaggatgatttattagatttttagttttttccaaaaaatgtacttaaatttagaaatatacctccaatttctgttttaaatgcattctcaaaaacttacatatctaaaggtatttatcattatactacattgttttcataattcacctattgttttctctctaacttcaagattacttaataatgggcttagtgatttccaaatatctgaaaattttaattgttgctggctttgaggaatataatatgatattgatgatttagaatacattgattactcctttgttgtctagttcatgacctacatttgaaaacatgacaaaatttatatttctttgttgaatgtacatttgtatacttttagataaagttattgaccatgttttttatatccttttcagcttttttacttttgattttcaatattattgtactggcttaccaaagaactagttaaaattaattttctacctatttccctatcccatttgtctaaattaaaattacaaaattatacttttaattatacttatgttacagattttcatattttttgattaatgtttctttatcactgtttcttataaagtcatttttggtatcctgtgattggccctttaagtggtgatgaatagaaataataaagcaactgaagcaaggtgatatgaaaaaatgagaagacagaaacaaatcaatgtgtccgtttatgtgaagtttaactgtataagagcaataacaaaaaaaacccagaaagttgtttttcaaaactattcatagaaactgagattacacagagagagagagagagagagagagagagagagagagagagagacaggccccaggtaaagaccaggctcctcatagaactctggccccaggtggacactgaactccaggtgtacattaggcccccagttgatgctcaggccccaggaaggtaaccaggcttatgatggatatatggctccaggtggatacccagaatccagtgagaaatcagggacaagtgggcaccaggcctcagagggatacctacgaccctagtgacctcaggccccagttggacagtaggccacaggtgaactccagtcttcaggtggacatcaggccccaggggaaatacaggtcttaggtttactcctaagacacaggtggacacaggtcttaggtttacccctaggacccaggtggacaacaggccctgggtggccactggccccaagtatccagtttcctaagagctagggtgggcaaccccactgggcactgtggccaggcctgccatgtctccttgttcagctgccacattctgatggggagggcgggaggtgtcgagagaccacaatctaagttcttattacctgattttatttcacctccactgagtgctcactctcctctcacctaacggatttactctcatctgcaggtggtttaagtgtgaaggtttactgaagatttaaagagtgttatcacagttgggatgatttaaactaacagtacacgttgcattttaagaaaataattaatcctcagaggagatatgggttatggagccatgacaaattttcagcattacttcccttacttgttgtttccaaataaaagatttttgattccccattgatgttggatgagaacgctgagtgtgcaagcaaaatatcattttttaactaagggcccaatagtgtcttaaatatgcagagctgagtctgcaggtggagagtgatgggtttgttcaaaacgtggtatagagtggccttgggtctcacctgcctgcccttccatcctgtgccctcccagtgaggcacccaagccccaccttagggcacaccccttcacagggccacataggccccagtcctcacctatgtggtcatctccaaatggcacagcaacaccttctgtccaggcccaggccagggtcccagtatctccaggggggcctggcatccaggcatctgttgagaactggcccaatgttggggtctgggctagcctgtgggacctggatgttggggggcagctgcatgaggactcatgcctggctttatgtgtagcaccaggaaaggcactttaatcgtattcatttattgctcacaaaacctctgaggtgggtgccttccccacgtcacagatgggaatgacaagaaataataaggttaaagagcatgctcatggttgaaacctggtcaggaactcagaactggagtctatagacccctacctgtgacctctgtggccggaggaccctctctcaccgggtttgtgtttgcagcatgtcctgtccttccctaagggtctcaggttctgaggcatggtgagggctgctggagcccatcactgagctgcagaaggagatactaacgctggccatgccaccctccaggcaggcacaactggagttgaaaatcgagatggggcagggctgccaggaacagagggaggcaggtggagaataactcaccagggaggggtttccctgctacagctttccagggccatttccactttctgggtggcattttggggcagctcacacagtacacccacatagccagtccccagggtcacaatccccagatgttgttcatcttggtgacaggccctgtgcttctccaggaccgtttgtgtatgggcccttcccaggtaagcgtgatacgtcctggctgtcctcagtccagggcactgccagcattttcctttctggtcagggtcaaagctttgttgaccatctccaggatacgatggccagctggcccttggagagccagtcactccaggtgacacggtttggtactggacgtccgcggtcccctctcccacgccgccccatactgggccccgtatccagccgccaccgctgctgcagcaagaaccgccccactgcctccgcgcagctgccattgtttaaagggacctcagcctgacttccaggagctacgcaagacttggccaagtcaatgcgcatgcgcaaggagagagccgcttctccccatcacagcgattcccagggttgtcgtagaaaccactccctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggagggtgttcgggtgagtctccccaaaagtcgtgcccccgtgatctggaggacaggtctgcctgtgtgtccgtgggctgctctctcacccgagtgtcgttcgcgtggagagcagaaccctgcagcctcaagggttgcctgccggctgaggtgggggtgcttccatgacaccgctgtatgactgtgtgcgtgtgtgtgtgtgtgtgtgtgtgtgtgtgtcccattctcttctctctcgctatcactctctatttctttccctctctctgtcggtttgtatgtgtgtgtgtgtgtgcccttgtgcgtgtgtgtgtttggacgaatgtgccccgtgcaccagaaagcaatttcttgcatgtcagtcggtctttggtgagcctttttcggcgtctctccctgggtcctgtggccagttgtccatcgttttcctgtcggttccactttgggtttgtgaaggcctcgacaacgtgaggagatgcgtcgatccccgagcaattgaaatctcatccctatcctgagtggcctcttttctaggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccaggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtggacatccttgtcatgattgtgtctctctccaaacctgtttctgcttgattgggcaggtttgatgaccctggagctcttagctttcatatgtgtctcagacagggaagctaccttggtctccatgtttcacctcatgggtagtggattgcctagaagcaatggtaagcgaccatgactggccttttcttctatgacgggcgcggtgtcgcatttcctctgcatctcctgtctcattcttgagggatgtcctctcctctgctcctgggtggactgactccctgaatcttttggccccctcctggattccaggtgttctttgattttgcttggcattgatggaaaggtcacttgtaccccccttcagttgggcacatgcctggacaccattgcttgtttcgccatcaccccatatgccctcggtgacacacatccacaccatctgctctgggatacaccagtgccacgcgtggtcgccttggttccacctcggaatcgccccgtccctgtttgcatgtgtcctggaaagcagtatcagcttgcaggagccccagggcttttagaagcggggcaggccactgctcttccaaaggaggagggaggcagagggctcatgggtcagtgaattttcagctgacactacgtcttgaggcccatgggaacattctgtgctgcagcgaggccctgcctggtcagcggatgtggtgagcccatcctttttcacctggaggggtccaaggtcggatccgaagaggcgtcctgagaccccagcaggcgcccttgagctctctcttcactggtggaagtcggctcaaggaggtcctgaagacaggactcctgagggtttggccctaggtcaccggcggacccctctcctacgctgccgctactggatcccggatccagccgcggccgaggttacagcaggagcgcgcctgcagcggcgcagcagccattgtttcaaggggacgcagcctgattgccaggagtggagcgcgagtcggccccaccaatgcgcatgcgcgaggcgccagaggattctgccatcagtgattcccatggttatcttagaaaccagtccccgaggcttggcaaagcaggagccctccgtggcagtgcttgggcgtcggggctccgaggcccaggcctgacctctccaggggtcgacaggaacgtctccggatgccaggagtctcaaagggcggaccagtatgacgaaaccacaggcagagtcccggggaagcagcgcggcatcccagcctcaggcctgcccggacggtgttcgggtgagtctccccaaaagtcgtgccccccgtgatctcgaggacaggtcggcctgcgtgtcgctgggctgctttctcacccgagggtcgttgtcgtcgagagcagaaccgcacagcctcaggagttgcgtgggggtgtgtgcttctgtgccactgctgtatgactctgtgtgtgtgtgtgtgtgtgtgtgtgtgtgtgtctcccattcgctcttctctctctgtctctcactctctgtgtgtttctttccctctctctgtcagtttgtgtgtgtgtgtgcacctgtgcttgtgtctttggacgaatgtgccctgtgcgccaaaaagcgatttctcgcatgtcggcctgattttggtgagcctctttctgcatcgctgcctggctcatgtggccggctgtcgatcgttttcaccgccgcggatccgctttgggtgtgtgaaggcctcgacggcgtgaggagatgcgtcagtcccggaacaactgaaatctcatctccatcctgagcggcctcttttctaggatcaagatgaccacactgaagccaaggacaaaatccttacaggagctcactgtcctgcaggagaggagcggacccacgtcagggaagatggtcgtatcttttcacggctcttctctgagaaatgaagccacaccaggatacaatcttgaagaggaagccgggaatgggagatggcagcaatccttgtccctgggatgctggcctctccggacaagtcacccgtttgacacccctccccttatgcctgtggcagtggcatggtgctgtatcctccctgggctctggcctctgctctgtcctccctcttgctctgtctcccctgtttctgagtggcctagatgcctcttggtctggctgaatgtctccaacaaagatcacttcccagtccatcagggagacagttggtggacatccctgtcatgattgtttctctctcccaacctgtttctgcttgattgggctggttggatgaccctggagagcttgagttccatagttgtctcagacaggcaagctaccttggtctccatgtttcatctcatcggtgggtggattgcctagaatgagcagtaggccactgtgatgggcctagtcttctaagacaggtggtgtcacatttcctctgcacttcctgtctcattcttgagaaatattctctcctctgctcccgggtggactgactccctgaatcttttagccccctcctggatcctggtgttctttgattttccttgacattgatggaaaggtcacttgtgccccccttccatctggcacatgcctgaacaccatcttgtgtttcgccattgccccatatgcctttggtaacaaacattcacaccatctgctctgggatatgccagtgccatgcgtgttggcatttgctccactttggaatcgcccttgtccctgtttgcatgtgtcctggaaagaggtatcagcttgcaagggccccagagcttttacaagtggggcaggtgactgctctttcaaaggaggagggaggaagagggctcttgggtcagtgatttttctgctgacaccatggcttgaggcccatgtgatcattctgtcctgcaacgaggcccttcctttctcagcagatgtggtgagcctatccttcttcacccagaggggtccaaaatcggatctgaagaggggtcttgagataccagcaggtaccctgaagctctccctccaccggtggaagtcagctcaaggaagtctttaagacaggactcctcggagtttggccctgggacccccgcagccccttctcccctgccgccccctactggaacctgcatcccgccattgctgtggctgcagcaggattccccctgccaccgcgcagtcgccattgtttaaaggggccacagcctgacttccaggagcgaagcacgagtcggcccagcaaatgcctatccgcgaggctctagctgattttcccatcacattgatttccatggttgtcttagaatccagtccctgaggcttggcaaagcaggagttctccgtggccctgcttcgttgtcagggctctgagcctccagcctgactcgcaagggttttaatacccttctcatcctcatctgcctctttgcgaggatcaagacgaccacaacccagccaaggacaaaggcctcacaggtgctcattgtccacccgcaggagggtgctcacagaccttcaagaagacggttttcactcctctcacactttgccctcattgagaaatctagccacagctagacacagggacagagaaggaagccagcaacgggatgcggcaagcatttctgtcacccaaacgctggccttcctggccaagtcacccgtttggcactttttcccagatgcccgtgatggtggcattgtgccatatcctgcctgggtgctggcctctgctctgtccttcctattgctctgtctgcccagtttcttggaatcctagaggcttcttagtgtggctcaacgtcttcaacaaagaacacttcccagtccatcagggagaaatttctttggggtccatttcatgattgcttccctctccaaacctatttctggatgattgggcaggtgtgatgatcctggagctctgggcttccatacctgtcttggacagggaagctcccttggtctccatgtccgaggtgatggctgcgttgtcggtccaggaagagtgggaggcgaccccaccgtggctgacctttgctttctaggaaaggcggtgttgcatcccacctgtgcttcctctctcattcttgagggccatccggttgctctgctcctggggaaagtgccttcaagcagtgaatcttttggttgccacagatgtgagggagccaaagggactgggttttgctggttttaggagaggtggcgtcagtggtacctacccggtggcagggtgtcgctgtggtggtttgtcgaaacctctcagcccctctggcaggcatccctgaatgtggcttggactcgggcacaggccctgtctggcaggttttcaggtgtgcttggcttttcctcagctttgtgtgggaggtcccagaagcccacggacgcacgcctggacgtcactgtcagtctcggcatcgccccatacggcctcagagacacacgctcactccatctgctcttgaaagacgtcagtaccacgtgtagtcacattggctccatctcagactcgcctctctctttgcatatgtcgcagaaagcagtttcgggatgccagagccctgggccttggagataaaggcaggccactgctccacccaggaaggagggaggcagtaggctcatgggtcagtgcattttcagccgacagtacgccttgtggctcttgggatctttctgtgccccagcgagacccttcccacctcactacattgtaaccccattcctgatcaccctatcagatccataatcagatccgaagaggagtccagaatgcccagccggcaccctgaagctccttctccaccgggaactgaagcagaagaccagaaaaccaatcaagaaggtcctgacgacaggactcctatgggtccaaccctgggtctcctgcagaccccctcctagtactcttcccacccgccaccttggactgcgccgctgcgccagtccccgcagcccgtcgtgtcgccgccattttttaaagggtccgcagcctgactctccggagcaaggggggagttggcctcgccagtgcgcatgcacgaggccagagtctctgctttggtaacagtgaccgcctctgttgcccagaagtgggtccctgagacttggcgaagtaggagccctgtgtgatagtgtgtcagagtcggggctgagaccagtcctggccagggtgttaacaggatggtctccggagatcgggattctcggagggtcgaccaccaggaagaaacctcaggagcaagaaagctcaggcagattgctggggaggcagtgcgagatcccaaactcaggccaggatttgcggagggtcaatgaggcccctctcccaatcttcacttcaccagccaccgccccagtccccgcagccgccgctctgccgtcatttattttattattatttttttttaatagtcggagtctcattctgtcacccagtctggactgcagtggcgggatctcagctcactgcaaactctgccgcctgggttcaagtgattctcttgcctccgcctcacgagaacctgggattagagggattaatcagaatcggggctaagaccagtcctggccagggcatcaacaggatggtctctggaggccgggattcacggagggtcttccaagaggaagaaaccgcgggcggaaggccgaagaagcagcgcgggatccctgcctcaggcctgcacggacggtgtgccagtgagtctcttcaaaaaaggagagatttgcttgtgtgcccatgggctgctctctcaccggtgggtcgtggttgcggagagtagaacccggaaaattcaggggttgcctgggggtaggtgttaccgtgccactgccctatgtctttgtgcgtttgtgtgtgtgcgtaggtctctctcttatttctctctctctcctctctcgctcttttgctctgtgtccgtctgtgtgtgcgtgtgtgtgtctgttgggacacatgtgccctgtgctccagagggcggtatcttgtacatcggcctttcttctggtcagcctctctcggcgtctctgcctggggcgtgtggccggttgtcagtcatttttccggtggctccaatttgggtttgtgaaggtctggcgaggtggggagctgcgtctctctcataaggatttaaatcaccttcccaccctgagaggcctcttttctaggattaaggcctccagcccccagccaaggataaaagcctcaccagagaggtcattgtctacctgcaggagctgtgtagagagacctggaaaaagatggttctcattcgtctctctctttcatctccttgagaaatctagccacagagtaacacaggttttcagaggatgggaatgggatgtggcaaggatctgtgagtgtgcaggctgtgtttcacatatcattaaacatagtctaatgagtgttctgcagatagctgacatttaagtttgttttattgaatcaaggaaaagaaaaaatgctgagaaaaaatgacacaacttccctgccacccatctgagtgttacaaatttaatagtaattttaatttatcttctcatgtaaaggtccttggcagtgatacctaatttcctaagatagccttgctttatttcgtatacttaagatgtcatgcatatcagagtatctggaaattcttcccaatgcccttgacatatgtgattaatcacattcccaaaataacataccaaaacaaacaacagaaaattatttgttacttaattccttcaaatttgtttatttaacttggggttccttcatgcacgaaacatttcatgtgtgtgtggcactcttctggtcacagatttcatcttaaataacctaagtattgaaatgcttgtgccctttgattaatttttactacataaatactttgattaaaagctacattgaggctgggtgcagtggctcacacttgtaatcccagctctttgggaggctgaggccagcagatcatgagatcaggagatcaagaccatccaggccaagatggtgaaaccccgtctcttcaaaaatacaaagaattagccaggggaggccaggcgctggctcatgcctgtaaccccacactttgggaggctgaggtgggtggatcacctaaggccaggagttcgagaccagtctgcccaacatggcgaaaccctgtttctactaaaaatacaaaaaattagctgggtgtggtggcaggcgcctgtaatcccagctacccaggaagctgaagcaggagaattgcttgaacccaggatgcagaggttgcagtgagctgagatcacaccactgcactccagcctgggcgacaagagtgaaactctgtcccaacaaaaaaggaagaaagaaagaaagaaagagagagagagagagagagagagagagaaagaaagaaagaaagaaagaaagaaagaaagaaagaaagagaaaccttgtgtatactaaaaatacaaaaattagaccctgaaggtcacatctgaatgagaaagacattatttggctcaaattgactgacactaaggaatagtgcagactggacaagtgaggtgacttacacctataatcccagcactttcggaggctgaagctggtggatctcctgaggtcaggagttcgacctcagcctagccaaaatggcaaaactctgtctctactaagacaaaaattagccgggcgtggtggtgcacatctgtaatcccagcttctcaggaggctgaggtgggaaaatcacttgaacctcgaaggcagaggttgtagtgagccaagatcgtgccaccgcactccagcctgggtgacagaatgagactccatctcagaaaaaaaaaaagtatgtaaatcactaatgtatcaaagaaaacagtcattcatgtattgcaaataaatactcaaccaagacaaaaaggcacgtcacatcttatgggaaaagacggaaatgacggtgagaggaaaactgtgacccttgaatgtaagacagaaaaaaatcagggcacgatgttaaggaattggaaataattctccatattaaaggaatacaagagacagaaagagaggagagagagacacgatagtcacagactgcaggggtgtggggtagatgggaatcaaggaggcagagagagcagtgggaatgtacataaaatcaccctccagagctgtgctgtccaataagtctgctgaacacttgaaagatggctagtccaacctgagaaatgctgtaagtggaaaacgcatttaaaaaaattctgaatacttagaatgggccagtgtgggggttcatacatgtaatcccagcattttggaaggccaaggcgggaggactgcttgagccaggagtttgagaccagtctgggcaacagagcaagacctcatctcttcagaaaaaaaaaaaaaaaataggccaagtgcagcggctcacacctgtaatcccagaactttgggaggccaagataggtggatcacttgagctctggagttcgagaccaacctggacaacatgccaaacccctgtcttaacaaggttttttgtattttaaacatggaagaaccccatttctactaaaaatacagaagcagccaagtgtggtgggccatgactgtaatcccaactactcaggaggctgaggcaggataatcctttgaacctgggaggtggaggttgcagtgagccgagatcgcaccactgcactccagcctggcaacacagtgagactctgtctcaaaatatatatatatacacacacacacaattttggagcgaagtttcaaaatcaatcagtaagcactacccaccaggtttatccttacataaagtgcccgctctgccttgaaaatcttatgctaagtggaagaagcccgtcatgaaatatcacatgtaattccatttaaataaaatgtccaaaatacatgaatgcgtagagacagaatgtagatttgtggtggcccagggttaggggagttgggggaaatggagggatatggggtttactttggggtaatgaaaatgagctaaaatttattgtggtgatgtttgcacaactgtgtaaatatactgaaatcattgaattttacactttaaatgggtggcttctgtgatatgttaatatttttcaataaaacttcaagaaaaagagtacctgtgtgcctccagagtccacatttttacacttgatgaagaaatcaagatattgtttcttcttcttctttatttttatttattttattttattttttgagacagagtctccctctcttgctcaggctggagcgcagtggcgtgatttccgctcactgcaacctcccagctaatttttgtatttctagtagagacggtgtttcactgtgttggctaggctggtctcgaacttctgacctcaaatgagtccaccatcttggcctcccaaagtgctgggattgcaggcatgagccactgcacctggctcaagatttagtttccattgtttcagatgccctaggaccattttattctactttaatttctgatgcatcatcgcagtggacattttacattagctcccaaagtattttactctgtttaagattttatcagctgggcacagtggctcacacctataatcacaacactttgggaggccaaggtgggaggatcagttgagcccaggaattcaagaccagtctctgcaacatagtgagatgcccatctctaaaaaaaaaaaaaaaatgtttaattaggtgggcgtattgttgcatgactatggtcccaaccagtaggtaggctgaagtgggaggatcacttgagcccaggaggtcgaggctgcagtggccatgattacaccactccattccagcaaaaatatttttaattacatttttttaagaaaacaaaatatacacttagtgacttgatacaaatgaatgacttttataatctacagaaaccaaaaaaataacaataatataaacccacagccattcttcttatgtgagtctctggtgtctctgagttgtaagaattgtgaattatgattaataacaaatatgcatgacaaggactcaataagggataggcattgataaactgcaaacaacacttactggagtaatgtctttaaagttgtacaagaagaagaaaaggcattgaaaaactgcgttggctaacaaaatactgaagttcacctaagtccattaatcagcacacgcacacacacacacacacacacacacacacaatggatgtgtaaaatggtcaacacagtctcccatgaatgtatcattttattaataggtctgtgagggtaagagatgaggttctatagatcctggaatcagggatggggaatctgtgaggtccctgaagtgatagatgagggtctgtagattggtgatgggtggtcttttggatactgatgaggtccacagaatcaattcttgtggatatgtagggtcagtgatgagggaatctggtgtcagtgatgggatgtgtgtggaatcaatgagaaagtgtggaatcaatctgtgaaggccagatttgtggtgtcatctctcaggctgacacatcctgatctgtgtgtcagtggtggaaattctatggggtcagagtgtgacagtcagatccctgacactgggtgttctgggtccggccaagtgcacagattcccttacctggtcctggctggagaggcccttctcacggactcctcacgtgaaaagtgggttgtcggcggtttttgcttttgctttgttttgtggtgggggtgggtgggttggctttttctttagggtttggttttgcctcttagagaccacagacacatgcagctcttaggaagaaatttttgtcttggcgatcgctaggtcctttggaccaagccatttaatgggaacgaagctgaccattcccttagagcagttcagatctagacggtcgctttaaggtgtccacaagggggactgcaagtggattgtggctttgagtggcaggtgggcgggaagaaacaactaagaaagacacacaagctgtcctcaggctgaatctatcacagctggaagaacagcctccctaacccatcaggcgccaatgggaggtgcctctgggctgtgagaggctggcggaggcgggacttccagacccagaaagtctgggcacagaagcctattactgtcagacgctgaggcgttgccgtgggaaccaagggcctttcgggtcagatcagagcctttctcagacaattctttccgtaactgacgagctcctgtccagcgcacgcctctatgaatgcttagtgtgccgtctcgggcagagtcttatttggtctgagagccacttgtttcttaaatccctgcgctaatcttgccgtctgctcctacgtagcccaggcatttgctgcatgctggtcctttctttcctgacaggggagctgcctctccagcttcctgggaggacagttcaaattatggaggaggggaggtgcagggcagcagtgcccaggggagtacaggggagttgggggagcaggggctcatttttctttgtagctcagattcccaagcctgtgactttgagaatctttgtcttccttgcaacgtttcaatctgaggctcttggggagagggcagagttggagccggatggaagcctggtggtgagaggagtgggtggagggaacatgaagaacgtgtcaggcggtgtctttatttctggcaccttactttgcctactggagtttcccagtctgttccagacgcactctcttgatcctgagggggcctgaggaggcatgttggttgccagtgtgtgctcccctgaactcgattggaattggtcccacaaactttttttttttgagggagtctcacactgtcacccaggctggagtgcaatggggtgatctcggctcactgcaacctccgcctcccaggttcaagtgattctcctgcctcagcctccctagcagctgggaattcatgtgtccgccactacacctggctaatttttttctatttttagtagagacagggtttcacaatgttggtcaggctggtctcaaactcctgacttcaggtgatccaccggtcttggcccctcaaagtgctgggattacaggtgggaaccatcacgcccgacaaatcccacaaatttaggcattatgatacatcggagccaccacgccccaccaattacacatatttaagcattatgatatattgctacttttagaatcacttggtttttatattgtgtttttcccccccatttgtttgtttgtttattgagacagagtcttgctgtgtcacccagcctggagtgcagtggcgcaatcttggctcactgcaacctccacctcacagattcaggcaattctcctgcctcagacttctgagtagctgggattacaggtgcatgccatcacactcggctaatttttgtatttacagtagagacagggtttcaccatgttagccaaggtggtctcaaacttctgaccccaagtgatccacctgcctcggcctcccaaagtgctgggattataggtggaagccaccgtgcccggcctcccctccttttcattcagggattttaaatgttttatttgctccatctgttatgtatgattgccttgacgatttcagcttgaatgaaaattacatatttttgcctgtgattattaatattgaaacatattaaaataatacatgttcataatgaaaatgaaacattacaaataaatacacaggaaaggcagtattccccctccagttccactcttgaaaataaccagttaacaggatgatgaacatctttccatgatgttctccaagattcatataattatttgcaataatacaatggcatatatgggccaggtgctgtggctcatgcatgtaatcccagcactttgggagactgaactgggtggatcatttgaggtcaggagttcaggactaggctgtccaacatggtgaaaccccatcgctaaaaaaaacacaaaaattatttgggcatggtggtgggcgactgtattcccagctacttgggaggcagaggcacgagaatcacttaaacctgggagatgaaggttaccgggagccgatatctcactacttcactcccacttcggcgacagagtgagattccatctcaataaataaataaataaagagaaagaaagaaaaaaagaaagaggaaagaaacaaagaaaaaaggaagaaagagagagagaaagagacagagaaaggaagcaagcaagcaagacacaaaaagaagtcgtgtgctcaggttgctaagatcgatggtaagaacaaatcctctagtggtaaaagtgtaagaaggaaaaagaaatttctgttagtcttgttggtttcaccccaagctctgaaaagtacagcacgtgtgtgataagttcttagttaagttgaaaaaggcattaaatttgtgcatggaaatcataaacagaaatgtgttctgattgacagcaattgggtcaatgctacgcaaggttcaggcatccactgcgggtcttagaacaggtctcctgcagataagggagggctactatataatgtttctttcttttttctttaattataaagtattctcctgtttatataacaatttgccatcgatatcactttaggtataaagatattaggatatctttatagtagataaaaactaactcattatttgtaagagttaaagtatcttccattatatgagcatttaaaatactaaagtacttttgccaccagaaatagtgcttctgtaaatattcttttacttatatctttaaattttacttctgctgaaatgaattgcatgaggaaacaaatgtttgtgtataaaatgtaatatatgtatatatatttaatatgtgtatatacaacttaatatatacacatacatacaataacataaccaatttttttgttgttttttgagatggagttttgcaccgttgcccaggctggagtgcagtggtgtgatcttggctcactgcaacctccacatcttggattcaagtgattctcctgcctcagcctcctgagtagctgagaatacaggcatctgccaccaagtccagctaactttgtccttttagtggagatgggttttcaccatgttggccaggctgctgtcaaattcctgaccccaagtggtccactgaccttgccctcccaacatgctggaattacagatgtgagccaccgtgccaggcctaacatatacaatttaatgtatatacaaatataggttgggtgcagtggctcactcctgtaatcctagcacattgtggagctgaggtagggaactgtttgaacccaagagtttgaaatcagcctgggcatcatggtgaaaccctctctgtccaaaaaacacaaaaatgagttgggtgtggtggcacacgcctgtgctcccagctactcaggagactgaggtgggaggatagctggagcccgcaggtcaaggctgcagtgagttgtgatcatgccactgcacaccagcgtaggtgacagagtgagcccctgtcttagacaaaaacgaatcaaaccaaatataaagtttatgcactacacacttgatttctttccaaagggttttacaacactatactttcaccagcaatatatgcaactactcatttcctacatagtcactatcacttgtgtgcagtcaaggaacttagtaggcttgaattgtccaaatcctgcacactccaaagaaaggtttgactctagcccagctcctgggaaatagcctttaagtccttggactctcctgcctatctgggagttaacaaggtgatttattgtggggaccttggaccatgcagtgtcagcttgaccttgggaagggggagacagagaaactaaggtcatccaaatgggtactcttgtccatgtgaccaacctccagtaaaaccctcaaccccaaggttcaggtaagcttctcatctgggagtattttctgtactttctgccacatatcactgggtgaattaagcactgtccacatgatgccactgggagaggacaactggaagcttgtgctttgtctctcctggactctgccctatgcacctttttctgctgctgattttaatctgtatccttttgttgtaataaactataactatgagtataatagcttgactcagttttgtgagttcttctaatcaatcactaaacttttgggaccccaaaacacaacgttgttgcttctttaattgaattctccatgttatgtaagaaacctatgtgcataattgaaaatcccactctaagaaagagatttccatgcagtctactcccccaccatttctccaatgctcccaagtctactttctgaataatcaaatgtttcaattttctaaatttagattataaactatttataatctatatatctgagtgcttatctctgttatataataggtagatcctcctccttctgttttttttttttttctgagacagagtcttgctatgtcacccaggctggagtgcagtggcgtgatctcggcttactgcaagctccacctcctgggttcactcccttctgctgtctcagcctccccagcagctgggactacaggtgcccaccaccacgcctggctcatttttttgtatttttaatagagacggggtttcactgtgttagccaggatggtcttgatctcctgaccttgtgatctgcttgcctcggcctcccaaagtcctgggattacaggtttgagccaccacgcccgacccctccttcttaatatatcaacttgatatattacctgatggcttcctgttctgatagctgatgacttggctgacactcacctcttaccccagtgcctgaaccactttccttatatggtgctctcattattttctttttcttttcttttctttttcttttttttttgagacagagtcttgctctgttgcccaggctagaatgcagtggcacaatctcagctcactgcaacctctgcctcccaggttcaagtgattctcctgcctcagcctcatgagtagctgggattacaggcataagccaccatgcctggctaatttttgtattttagtagaagcggcgtttcaccctcttggccaggctggtctcaaactcctgatctcattatccacccacctcagcctcccaaagtgttgggattacaggcatgagccactgcacctggcctctctcactattttcaatggctctgttggttactgttcacaacattcaacaattagacttatacctcatttatttatttatttttaattttttctatttttaggtttaagggatacatgtgcaggcttgttacatgggtaaattgcatgtcactggggtttggtgtacaaatgagatcatcacccaggtagtgaccacagtacccaatagttttttgacccatagcctcatgccaccctccccactcaagcaggccccagtgtctttgatcccatctctgtgaccatgtgtactcaatgtttagctccaagttataagtgagaccatggagtatttggttacctaatgctgcattaattcatttaggataatggcctccagctgcatccatgttgctgcaaaggacatggtttctttttctacggctatgtagtattccatggtgtataattaccacattttcattatccagtgcactgctgatgggcatcatatatgcaacttcacactatactactaggctacagtaaccaaaatagcatagtagtggtacaaaaagagacacatagaccaatggtataggttagagaacccagaaataaagtcacacacctacaaccatgtgatcttccacaaagtcaacaaaagcgaggaatggggaaaggactccccattcaataaatgattctggaataactggctacccacatgcagaagactgagtctgggccccctacctttcaccatatacaaacattaactccaaatggattaaagatttaaatataagacctcaaactataaaaatcctggaagacaacctaggaaatactcttctcaacatcggccttggcaaggaatttttggctaagattccaaaaaagcaattgcagcaaaaacaaaaatagacaagtggtacttaattaaaccaaaagctggaggccaggttgggcagatcacaatgtcaggagtttgagaccagcctgaccaacatggtgaaaccctttctctaataaaaatacaaaaattaggtggttgtggcgcacacctgtaatcccagctattcaggaggctgagggaggagaatcacttgaacccaggaggcagaggttgcagtgagctgagaacgcaccactgcactgcagcctgggtgacagagcaagactccgcctcaaaaaaaaattaaataaagtaaaataaaagtgtaaacacaacaagacaaactatcaacagagcaaacaaactacagaattggcgaagatactcacaagcgatgtatccagcaaaggccaaataatatccagaatctatagacaacttaaacaaatggaacttaagcagaacccttactctttagcaagttctgtatgcataagcctctctttgttcttattttggtggcctctgtttatttacacaaagagaagaactgctattcctgtaaatcatggctttgaaaatggtcacagtttgctgggcatgcttgctcatgcctgtaatcccagcattttgggaggccaaggtaggtggatcacgaggtcaggagatcgaggccatcctggccaacacggtgaaaccccatctctactaaaagtacaaaaaaattagccgggattggtggcatgcccctgtaatcacagttactcaggaggctgaggcagaagaatcacctgaatccgggaggcagaggttgcagtgagccaagatcataccactgcactccagcctggatgacagagtaagactctgtctcaaaaaacccaaactgttcgggataagtggctcatgcctgtaatcccagcactttgggaggctgagtcaggtggatcacaaggtcaagaattcaacaccagcctggccaagatggtgaatccccaactctactaaaaaaatgcaaaaattagccaggcaccatggcaggtgcctgtgatcctagctacctgggaggctgaggcaagagaattgcttgaacccaggaggcaaagtttgcagtgagctgagatctcaccactgcactccagcctgggcaatagagtgagaatctatctcaaaaaaaaaaaaaacatggagaaactccatctctactaaaaatacaaaattatccaggcttggtggcacatgcctgtaatcccagctacttgggaggctgaggcaagagaatcgcttgaacctgggaagcagaggtttcggggaggcggaggttgaggtgagccaagatcatggcattgcactacagcctgggcaacaagagtaaaactctgtctaaaaaacaaacaaacaaacaaaacaaaacaaagaaaattacgcacaacttatttcctggtttgtgataatctgtgaaatacattttgaaatgaattggaattcaatacagtactattcacaccccaaatactcctaatatttcctttcagagatgatgacctggcactcttcctaggacttgacttctccctacaggtccccagtacaagtatttgtgattctgagttaattcattgtctacatgtgtgacaatgcaatgctcttgttgttgtaaagtaccaagatgagtcaggtccaaactgcacatttgtagagaacatagtatatgtgcaattgagcatgtatgtggttatgatactgaaaataatacgaacataggccagagcagtggctgatgcctgtaatcttagcactttgggaggccgaggcatggagatcacctgaggtcaggagtttgagaccagcctggccaaccagcctggccaacttgctgaaaccccatctctactaaaagtacaaaaaattagctgggcgtggtggcaggcacctgtaattccacctactcaagaggctgaggcagaagaatcgcttgaacccgggaggtggatgttgcagtgagccaagatcacaccactgcattccagcctgggtgacaagagtgaaattgtgtcaaaagaaaaaaaaaaaaagaagaacattggccttgggcgtttctttaggttgcctcctgtgttctatttatagcatgcctttatcagggttttggggtttgggactaattcccaactttctggcaccgtaaagtgtttcgattcatctggtattttccctgacccagacatggaataaaccatttatttaaagatccttggtttcttttattgaaaagtattatttacaaagcaccaaaatcttgggctgggtgaggtggctcaggtctgtaatctcaacactttgggaggctgaggcaggaggatcccttgaggccaagagtttgagaccgtgcaagatcaggccatgcacaatggctcacacctgtaatcccagcactttgggaggccaaggaaggtggatcactgaaattcaggagttcaagaccagcctggccaacatagtaaaaccctgtgtcaactaaaaatacaaaaaaattacccagaagtggtggcacctgcctgtaatcccagctacatgggaggctgaagcaggagaatcgcttgaacctaggaggcagaggttgcagagagccgatcgtgccaccgcacttcatcctgggtgacagagtgagcctccatctcaaaaaaaaaaaaaatctttgcaagatgaatgctacaaaatgagggcaaattgttggctataatcggaagactttttctcgattgaatgctctatcccaaagttctatgagaggtggtttgtgtgtgtctattggctgccttgtggatagtatgtatgattgatcctcagtgctttgggaattatgtaaaatagtttatattatgaaagtaattcaacctagcattaattgtgctaagtgttgaaaacgaaaagtgttgactacatctgaatgaatgagtatctggcttaccggttttgtttttgttctgttttggttttttttgtttgtttgtttttgttttttgagatggagtctcactctgttgcccaggctggaatgcagtgacatggtctcggctcactgcaacctccacctcctgggttctagcaagtctcctgcctcagcctcctgtgtagcagggactacaggtacatgccgccacccagctaattttttgtattttagtagagacacggggtttcaccctgttggccaaggctggtctcgaaatcctgggttcaggcaatccacccaccttggcctcccaaagtgctaagagtacaggcgtgagccaccgcaccagcctagcttacactttacagcttgtttcttatgcataatagtttttgtttggttggtttttgtttgtttttacaaacagggctatgaaaccatcaagatttgtggatcatcaaaaaacaaaacatcctgataaaattgagaaacaatgtttaaaaagtttaaaatcgaattttgaactgtaacactgttacttcttatttaagaaggacaaggagccgggtgaggtggctcacacctgtaatcgcaacaatttgggagaacgaggcgggtggatcacgtgatcccaggagttggagaccagcctgggtaatatggtgaaaccttgtctctactaaaaacacaaaaactagcctggcacggtgtgtgcacctgtaattccaggtactggaggctgaggcaggagacttgcttcaacctgagaggcggaggatgcagtgagccgagattgcagcaccatgctccagcctggactatacaacgacactcgtctaaaaaaaaaaaaaaaggataagcaaattatggtgaaataattgccctataaaattgcagaaataggccaggcgcagtgactcacgcctgtaatcccagcactttggaaggccgaggcaggcggatcatctgagttcgagagtttgagaccagcctggccaacatggtgaaaccctgtctctactaaaaatacaaagtcagccaggcgtggtggcacacgcctgtaatcccagctactcgggaggctgaggcaggagaatcacttgagcccaggagatggaggttgcagtgagctgagatcgtgccactgcactccagcctggctgacagagcgagactctgtctcaaaacaaaaaaaaaagaaagaaaaaaaaagattaatcgttgtaaaaccccatagtgctttatagttgctgaaactgtcataggactcacattagagaccgtaacttcaatagtgatgtatcacattgccattatttcacaatcactcctattgagcaataattcaattcaaagatgctttaatgagatgtcaggtaataccaaagagtagctgattaatcaagtaagtttcctattcagatcaatgaaatcagttactgagagtaaggcctgacaataggacatgtttgttatttcaataatgactgcaaactagaagaagagatacttgtaaaatctttagacactgaccgtaccagaacatctattcttgctgctataaaaacttggtttggggctgggtgcagtagctcacgcctgtaatcttagcactatcatttcctcatatgatatggaaaatgccgacctctgcatcctaactctaaactaatttcccactcacttactaagcttcagtcacaccaggctgctttctgtttccggaacgctccaagtgctctctgatttttcagggtctttagtgtagctgtgcctctgcttggactacccttccacactgctggcttctcaccaccaaagctcgagggttatctctcagacacccatcctatcaatgctacgcgaagtatccctcaagttactgcttataccacctattgatttatttcatagtatttatcacaatataaaattacttcatttcccccctttaatttaaaatcttttttttttttctccagactagaatgtaaacctcatgtgggcagcagacatgtctgcttattttttttttttttttgagacagagtcttgctctgtcacccaggctggagtgcaacggcgcgatctcggcgcactgcaacctccacctgccaggttcaagcgattctcctgccccagccctccaagaaactgagattacaggcgcccaccaccaggcctggctaatttttgtatttttagtaggggagcagtcggactctggactatatttcctggaggatcctgcaggccgataccacgtctcgcgagattttggcttcctcttagccaggtggcagaatctttcgctgtgcgcaattagctgctgccgcgccttggagtctggagcaacttggccaggctggccccgagcggaactagagaaagctgaggatgaggaatccggcttctgtccttttgtgtgtggagggctgaggagaggagtttgcgtgtgtgattgcgatggttgccgtgggtcttcgtggtctgtgactgtggctgtgtggtgctgactctgggtgatcaggtgggcgcttgtgactgtgcgcgctcggagtggatgtgtgtgtcctggacgagccgcgttgtgtgtgcggatgtggacaaccgttgactgtgtggttggggatgcgtgtcccagggtgggtgtgtgactttgcgtgtgtgtgcaatactgtgtgtgcgtgagttgcaggtctgtagctgtgcaggtgcaacttgtgtggccccgtggtctgtgtgagagaggagagtgtgatcggctgtgaggcagagggtaagtggatatagggaggcatgtgtgcgattggaactttgtgtgtccccctgagagaaaaaaccctttagggagttagggcgggtccttggtaaaactcctttaaatagagaacagcctgaaaaatcaggctgcaggcacagagaaggaaaactagcacagggggttgtcctaaagacattcctcagctgcattgataagggaccgaggcccaacatagaaatgcctttgtcctttgtgtgaccagcgggcttccaggaaatagtcactttttttgtgggcatgtatacggtgggctctgttaaattttgaagggaaggtgaaggttaaagaaagagagagagttggcggctctatggaggggaccaactaaatgccagagcccactgccgcttacaggctggagcaggaggggtctgggcagtatggcttgttgcctgggagaatgttgataaggatgtttcttgggcctttccccagcaggatgtgataaggaagtcaggcggttgggtaggatgtttctctcagcccaaaccccagtggaatgtttccctctgaccagggtctgtgaaatggtgggggcttacaaaacggtgcagcttggactagcaggctctggcggccactttccttttctggacatgctttggactgtgagccgagcctctatgaatcatcacttcagcccctgattggtcctgggccaaactttcactttagcccctgattggtcctggaccaaattttcacttcagcccgtgattggtcctaggccaaactttcacttcagcccctgattggtcctaggccaaaatttcacttcagcctccgattggtcccaggctaaggtcccagggccaaacgaagtagtgctttctccaagacagcccacagaccagtgagcacattcctcccctgcccagttcacaaaacccccagattcagcctcctagttggcaaacctcttttgggtcccctctccgctggggagagctttcttcttttgcttattaaacttccgttccaatctcatcctttgtgtccacgttccttaatattcttggctgtgagagaaagaaggcaaagacaagagcctttatcctaacaactcaattgctggagagaagattcgtgcatattctatgtggcatcacacgccatagccctgggattgaaagccatgcagtttatcggatggtgtcaatctcagtccaaatatgtaataagatctttcactttgctgtattttaggggtaggaatgagattgggggtttgatcaatagtttgtacccataggaccagggatttgcccagtcatctgtgagtaaatgcttaggccagtttccatgtctgtattgaattaaatactcatacggttctgtgattttgtcaaatacagatttggtctttgtccctattttctggcatacaactcctaaactccttggaatctcctaagtgcttgctttttttttttttttttttttttttttttttttttttttttttttttaaatggagtcttgctctgtcacccaggctggagttcagtggcgcgatctccactcactgcaacctctgcctcccggattcaaacaattcttctgcctcagcctcctgagtagaccacaggcatgcgccaccatgcctggctaatttttgtcattgttttcttttttagtagagaaggggtttcaccatattggccagtctggtctcgaactcctgacctcaagtgatctgcctgcctcaggctcccaaagtgttgggattacaggcatgtgccaccgcacccaggctttggctttttatatgttagtgattgaccgatagcttcaggatgggggctgctcatcagaaagaccaaggcaggattagagggttgggactttcagcccctaccctcccacccctggggagtggaggggactgaggactaagttgatggcaagtggccaatggtttaatcatgcctatgtaatgaagcctccttgcaaacccaaaaggagtggattcggagagcttccagagagctgaacacatggaggttcctggagggtcgtgcccagggagggaatggaagctctgtacgccttcccccatacctcacgctaggcatctcttcatctatatcctttggaatatccttataatcaaacagtaaatgtgtttccctgaggtctgtgagccattttattctagcaaattaatcaaacccaaagagggggtcgtaggaaccccaaattaaacccgtcagttggaagttccagagggtgggacttgtgactggtgtctgaaaggcgggcagttttgggggctgagccctcaatctgtggggtgacactatcacatggtagatagtgtcagaatcgaattggtggccacccagctggtgtctgctgcagaactgattccttgcttgctgatagggagaaatctcctcatattttgaggccacagaagtcttctgggtagattgttgtggttttggtgtgaagcagaggaagaacacaggttgagtttttccaaatgggttcacattgggggtcctcaacctcaaatccatcaactccatcgctgaatttttatttatgtatttatttttatttatgaggtagggtctcactctgtctcccagactggagtacagtggtacaatctcagctcattgcagccttcatctcctgtgctcaagtgatccttctactcagccttccaaataagctgaaaccagaggcacacactagcactcttgcataattaaaaataattttcagtagagaagaagactcactgtgttgtctgggctggtcttgaactcctgacttcaagcaatcctccccctctgcctccaaagtgctatgattacaggcatgagctgcctcacctatcactgattttctctttctttctttctttctttctctctctctctctttctttctttctttctttctttctttctttctttctttctttctttcttcctttcttttttttttgacagagtctcactctgccttgccaaggttgaactgcagtggtgtgatctcggctcactgcagcctccgcctcccgggttcaagtgattcttctgtctcagcctgctgagtagctgggattacaggtgcccgccaccacacccgaccaagttttgtatttttagtagagacagggtttcactatattggccaggctggtcacgaactcctgatctcaggtgatccacctgcttcagcctccaaaagtgcagtggcaggatcagggcatacggcagtcttgacctctggggctgaagggatcctccctcctcagcctcccaagtagctggattataggcatatggcaccatgccgggctaatatttgtaatgtttgcacagatggggttttgccatgttgcccagtctggtcttgaactcctgagattcaacaatcttcccacatgagcctcccaaagtgctggaattacagggaagagtcactgcacccggcctgtcactgcatttttaaagggaaggaggactatagtgagattcactaaggcttacaaaaaaggtagaaacctagatagattaaaagacagagattataatatccttgagatgataatattcaaatttagctttcatagatagggaaatttgaagtacatcagactataaggtggcattttgtgcaactaattaaaactatgttgtaactaacctgcacaatgtgcacatgtaccctaaaacttaaagtataataaaaaacaaaaacaaaaacaaaaaaaacaaaaaaaaaacaaaaaaaaaacaaaaaaaagaaagagagcaattgcattttcattactgagtaatattaagcaacaatgaaaataaatagaaataaccaagaaattgttatatttaaatcctccctcctttattggaaagagaagtattgatatttttagattctaatcaaaacttcgcttttaaaaaaattgatgattctatggagatagggagggaataacctatgtttattgaacacctaatattccacttacccgaatgtcatttattctatattctagtttttttgttgagacagggtcttgctctgttacccagcctagagtgcagtggggtggtcacagctcacagatatataccaccatgcctggcttattattttattttattttattttattttttgttatttttgcagagacggtgtctccctatatttcccaggcttgacttgaacttctgggctcaagtgatcctcctgccttggcatcccaaagtcctgggattataggcataaaccactgtgctcaaccaatattatagtgttaatagtagaagtgtcttagtgtactggaaaactttttctaaattttgaaaaaatattaaaaaacacgttggttttatttggccaatactgatttctttgctccatcattatttattggcattattagcctgttgactttcaatttccttacatccctttcactccatttcttttattttgtaccccaaatagaaattctttttttttttagatggattctcgctcttggctcttgtgacccaggctggagtgcagtggtgcagtctcagctcactgtaatcttcaccttccaggttcaggtgattctcctgcctcagcctcctgagtagcctagattacaggcaagcgccactacaccccactaattttttgtattcttttttttttttttttgagatggagtttccctcttgttgcccaggctggagtgcaatggcacgaactctgctcactgcaacttctgcctcccaggttcaagcgattctcctgcctcagcctcccaagtagctgggattagagggtgagccaccacacccgactaatttttatatttgtagtagagacagggttttgccatgttggccaggctggtctggaactcctgatctcaagtcatccgcctgcctcggcctcccaaagtgctgggattacaggcatgagccactgtgcccggcattttagtatttttatatttatttatattttgatagacagtctcgctctgttgcccaggctggagtgcagtggcacagtctcggctcagtgcaacctccgcctcccaggctgaagtgattctcctgcctctgcctcctgagtagctggtattacaggcacctgccaccacgcctggttaccttttgtattttaattagagacaaggtttcaccatgttggccaggctggtcttgaactcctgacctcacgtgatctgcccaccttggcctcccaaagtggccttgcttgaggccaggagtttgagaccagcctggccaacatggtgaaacctgctctctaccaaaaatacaaaagaaaattagctgggtatggtggtgtgtgcctgtattccaagctactttgatggctgagtcataaaaaatcacttgaacccaggaggcagaggttgcagtgagctgtgatcacctcactgcactatagcctgggtaacagattgagacttgtctcaaaaaaaaaaaaaattcttggcaggacgtggtggttcacacctgtaatcccagcactttgggaggccaaggtgggtggatcacctgagatcaggagtttgagaccagcctgactaacatggagaaactccatctctcctaaaaatacaaaattagctgggcgtggtggtgcatgcctgtaatcccagctattcaggagggtgaggcagaagaattgcttgaacccaggaggcagaggttgcagtgagccgagatcacaccactgcactccagtctgggcaacaagagcaaaactccatctcaaaaaaagaaaaaaaatctttactttggataaatacctagaaatggaatttccaggttggcctttagatattattaatggatttaatatgaaaaacctttacttgaggatgtataaagctttaaaagacagggtccctattcttaagttataaataaagcagcatttgtaaggtaatattcagaaaacatcagataatatcctataaagtcctcctgttcatgctgatgacattgtatggccagttaaggatgacacttcattctgtcccctgcaaccacggtcctgacatgtctaaatgacactggccctatgagaacactgtggatgtgaaagcatttcctcaagttatctttttggcctgctggttttaatctaatgatgggatatccaaagtgaatctaaaggagtgacatgattgtgcatctgttggggggaatcagagacagctagagcaaaggcagacacgtgctgaactcatctgtcttaagagctgaagcaagcagcagtattgctagcagagctactgcacatctgcacatgtgctccaatggctctgatctgtttttttcccagtatgaacctaatacatgaggcaagttagaaaatcggagttggccaggcatgatggctcacgcctgtaatcctggtactttgggagccagcgtgggtggctcacttgaggccacaattttgagaccagcctcagcaacacagtgaaaccccgtctctactaaaaatacaaaaattagctgggtgtggtggcaggcacctgtaatcccagctatgggaggctgaggttgcagtgagccaagatcaggccactgcacttcagcctgggtgacagagcaagactgtctcaagaaaaaaaagggaaaggaaaggaaagaaaatcacagcttgttaacctcttgcagctaaacacatatgcacaaaaattattcagtaaaagcaaaacagttttggtgtatcttgagattttgttttatatccaaaggaagactatatcttttatctttgaactactctttggaaaatgccttctatataacaaatgttatagttttcttctaattgggtcttgaggtctctcaggagaatggctataaactctacctcactctaatggggctctaggggaggggcctgtgggtctttagagtagcctttcaccagaaatttctttttcctggaccacagcctaatgctcaagtatctgacccatgaccaggtgtctcacaggaaacttgtttatactggcagatgcccttgtaacttttgtctgacctgtgtgcagtttattcctaccatgatacccactcttttttttttttttttgagactcagtcccgatctgttaccaggctggagtgcagtggcacaaccttggctcactgcaacctccaccatctgggttcaagcaattctcctgcctcagcctcccaagtagctgggactacaggtgcacgccaccatgcccagctaatttttgtatttttagtagagtcagagtttcaccatgttggccaggatggttttgatcccttgacctcatgatctgccctactcagcctcccaaagttctgggattacaggcatgagccaccacgcctggcctttttttttttttttttttttttttttttgagacaggatcttgctctggtgcctaggctggagtgcagtggcaggatcagagctcactgcagccttgacctcctaggttcaagcaatcctcccacctcagcctcccaagtagctgggactagaggcatgttccactacatctggctaatttgtatatgatatgtatttttgtagagatagggttttgccatgttgcccaggttgatcttgaacttctgagctcaagcaattcacctgccttggcctcccaaagtgctgtgattacaggtgtgggttaccacacccagccaatgtacatttaattatcaaagtactatctatactattttatggaagtactaattatcaaagtgcaatagaggttttgttgttgttgttgttgtttttcttttgagacagggtttcactcttattgcccaggctggagtgcagtggtgcgatctcggctcaccgcaacctccacctcccaggttcaagcgattctcctgcctcagcctcccaagtagctgggattacagacatgtgccaccacacccagctaattttatatttttagtagagactaaaatggtctctccatgttggtcaggctggtctcgaactcctgatctcaggcgatccatccgccttggcctcccaaagtgctgggtttacaagtgtgagccactgtgcctggccaatagaggtttttcaactttttgtagatatttttgaaagatcctgtcttcctttaaaaaaagagacaaggctggatgtggtggctcatgcctgtaatcccagcactttgggaggtcaaagcaggtggattgcttgagctcaggagtttgagattagcctggccaaaaggcaaaacctcgtttctactaaaaatacaaaaaaaaaaaattagctgggcatggtggcgcatgcctatagtcaaagctaatacagaggctgaggtgggaggatcacctgagcctgggaggttgaggctacagtgagctgtgattgtgccactgcactccagcctgggtaacagaacgagaccctgtttcaaagtgaaaacaaaaacaaaaaaaatgaaacaagagaaaaaaaacaagaaagaaagtggtgagggggaagtgcctatttattaagcttttgttgtaaatagtaacttgcatatcagatgtttactgtaatattcttgaagctttgccaggcctgcagcttgctgtgtgcttttcaactctatttcatttatttgggaaataatatatcaatgtactttattcattcccagctctaaccatggaatactgggaatgtcccattctatgaaggaggtttgccggccacaacaggaatattcatgaacatggaggtcctttgttgaagttacactaatttttttactcttccccattctgagcctagccggtctgctcactatattcgctccatccttcagcacccttccatctcttgcttcatcttaaaaacctttcctttaatttcaacagtgctgcctgagtttgtcatttcaggggttgggcatgttccaggatctgtctatagacttctctcaggaggaatgggagtgcctggacactgctcagaaggacttatacagagatgtaatgatggagaactacagcagcctggtctcactaggtaagtatgtctatccccaaataactcatgaattttgagtgtagctttcacttgtctgggtgacttttcacctgctgcttagggaattgttttgtgttttgtagattaatatatgggcagctctttgggttcccttcatcttctccatgcttcagacctttacaccttcctctagtccttcatgagtactaagggactaactttgaattcaggaacagcacgagtatgtcttacttcttttctttctttctttctttctttctttcttttttttttttttgagatgaagtctcactctattgcccaggctggagtgcaatggcatgatctcggttcactccaactttcatctcgggttcaagcgattctcatgtctcagcctcctgagtagctgggattacaggcacctgccaccatgcctgaccaatttttgtgtttttaatagagacggggtttcaccatgttggtcaggctggtcttgaactcctgacctcaagtaatccacctgttttggcctcccaacgtgctgggattacaggagtgagccaccatgcctggccatcttacttcttttcttatagacaggtctctctatcccaaagcctgatgtgatttccttactggagcaatggaaagagctctggatggtttcaagggacgtaccaggaggatggtgcccaggtgagtaaggactgagcagatgaggaaggcactgctgtttagaacccagcccatcagggaggcagcactgtaaaggtattggttgaggaatctcttctgcaaggtcccatgtaagagttgtggcctaagacacatggagaaaagtcaagatacccccgtcacacacacacatttttttaattttttttaatttgagagagagtcttgctcagtcacccaggctggagaacagtgatgcgatctcggctcactgcaacctccgcccccgggttgaagcgattctcctgcctcagcctctaaaggaactggcattataggcgcctgccaccatgcccagtaatttatgtatttttagtagagacagcatttcaccatgttggctaggctggcctcgaactcctgacctcaggtgatccacctgccttggcctccaaaagtgctggtattacaggtgtgagccactgtgtctggccaagaacccccttttacctccacctcttcagtctgtgctaccctcttgtcatcgtttctttccatttcaaagaataacattcccttcttcagaagccatcctgtttcctctatcttggagctacttctttcactttaaaaattaaacctgtgttgctgccttaaaaacaaatcttttaaaatatatttatttttcatactgatccttgactttttttgccttgtcttttcttggctagttttcctttaatgcagccatttcatgcatgaatggatattcattcactattttttttttttttttggatacagagtctcactctgtagcccgagctggagtgcagtggcgcgatctcgtctcactgcaagccaataagaagcgcttggggatgacctccctacaagcacagcaaaacttttcttgcgcatttctgcgctggaacgcctacccgctccgccaaaccaaaactttactatcacccttagtgccgtgtcctgcactttcttggagatttgtaccaggcgctggagactctcccacctggtccatgcccgccgcccggtgagcactgagacccaaccttgtgcaccgccagtcttgttatcaacaaacaggctagtaaattataaaaaataaaataaaggaaatgtagctggccgtggtggcatgtgcctgtaataccagctactccggaggctgatgcaggagaatcgcttgaacccaggaggtgaaggttgcagtcagccgagatctcaccactgcactccagcctggatggcaagagcgaaactccttcttgaaataataaataaaataaaggaattggggccgggcgtggtggctcacgcctgtaattccagcacttttggtagccgaggtgggcggatcacttgaggtcagaagtttgagaccagtctggccaacatggtgaaaccccgtctctactaaaaataaacaattagtcaggcatggtggcgggcgcctgtaatcccagctatttgtgaggcggaggcacaagaatcgcttgaatcccggaggcagaggttgcagtgagccgagctcgtgccactgcgctccagcctcggcgacacagcgagactccatcttaaaataaaataggctggctgagggtgctcatgcctgtaatcatagcactttggacgccgaggcgggtggattgcctgagctcaggagttcaagaccatcctggcctatatggtgaaaccccatctctactaaaaatgcaaaaattagccgggcatggtggcgcatgcctgtaatcctagctacttgggaggctgaggcaggagaaccgtttcaacccaggaggcagaagttgtagtgagccaagaccgccacattgcactccagcttgggcaagaggattgaaactccatctcaaaaaaaaaaaaaaaaaaaaaaaacaaataaataaatataaaagaaatagacaaagcaaaccttaatgcatgaactcaaacaaatgctttcactgccaggctccatctttgcaaatctgaacctagaacaatgtgcacgtttctaactagcaattctggaggacagatcagggaggcagtgtgagcttgcttttctgcaatttaattgactggtcagtaaagtcagtgtttgcaggcattttcaatgttctgtagtgggcttcagttcctatggcagtgtggcaggccaggtttccaatagcaaccagaagagtttctactaaccattttctataattttgatgaatgcataagttaacgttaaagaaatggagaaactggtgcctgagtatcagggatggaatgtgaaaacaaacctattgaaaccccgcctgggttttctcagaccctaaagtctgatcgaataatgatagcattggtacacattcacttcggcctgtcttaagattcagaaactttcccagatgctagagaaatctttccagactctagacccaagttaaagattagatgttgattgaatgaaacactcctgcttgtaggtgcaatcccacatggagcttaagatgtatataagcactagaaaaaaaaacttgtaactttgagttgatctggtgagttacctggcgcttctccctgtaaatggctgcagaaataaacttccttctttcccagtctgtctgtgtcttgttattgagcaattgcggtggacctgcccagcaaagtcctcttttgtgtggttatctgggactccttttggagggaacattttaaactttccatttcagagcattctgttggcactcttacactgtttttctctgcctaccctgggacctgagttctcctggacgtgaatctccagccacagagcctagaagcccattcctccacattctgtgactgttccccaaacacagggagaatttgcagaaaataagcccaaaaatcttgccattctttgcaataaaaccccacattacaaactgtggaaaacaggattttagcctgaataggtttttcctctatttgaaaccctttacaattttggagggaagtttccaaatcaatcagtaagtaccccccaccccaggtttatccttatgtaaagtgccccctttgcacatgcaagattgaataaaccttgaaaatattatgctaagtgaaagaagccagtcacaaaggaccacatgttatgtaattccatttaaataaaatgtccaaaatagaccaatacatagaaacagaaagtagatttgtggtggcccagggttaggggagttgtggggaaatggagggatatggggtttacttcagggtaatgaaaatgatctaaaatttattgtggtgatgtttgcataacagtgcaaatatactgaaaacctttgaattttacactttaaatcagtggcttctgtggtatgttatcaatatttctcaataaaacttcaaaaaaaaaatagtgcctatgtgtctttttatgtattattcctccagagtccagtccatagtttttacatttgatgaagaaattaagattttgttttgtcttcttcttcttcttctttttttttttttttgagacagaatctccctctgttgcccagactggagtgcattggcacaatcttggctcagtgcaacctccaggttaatttttgtatttttagtagagacagtgtttcaccatggtggctagactggtctcaaacttctgacctcaagtgagtcccccaccttggtttccaaaattgctgggattacaggcgtgagccaccatgcccagcccaagatttagtttccgttgttttgatgccctagggccatcttattctaccttaatttctgacgcatcatctcagtggaaattttacattaggttccaaagtattttcctcttttgaagattttatcagttgagtacagtagctcacacctgtaatctcaacactttgggaggccaaggtgggaggatcagttgagagcaggagttcaagaccagtctctgcaacatagtgagacacacatttctacaaaaaaaattttaattaggtgggcatatttgtgcattcctgtggtctcagattactacgtaggctgaggagggaggatcacttgagcccaggaggttgaggctacagtggccatgattataccactgcactccagcctgggtgacagagcgataccctgtcttaaaaaaaaattaattggaattttttttagaaaacaaagtatacacttagtgacttgatacaaatgaatgaatttgataatctacagaaaataaaacaaataaataaataaaaacccaaagccattcttcttatgtgaatctctggtgtctctgaattataagaattgtgaattatgattaataacaaatatgcatgacaaggactcagtaagggataggtgttgataaactgcaatgcacacttactggagtgaggcctttaaagatgtacaagaaaaagaaagaaaaggcattgaaaaattgcattgcctaccaaaacgctaaagtttacctaagtccattaatcagcacacacacacacacacacacacacacacacgcaataggtgtgtaaaatggtcaacacagtctcctatgaatgtatccttttattaataggtctgtgggggtaagagatgaggttctatagatcctggaatcagggatggggaatctgtggggtccctgggttgagagatgagggtctgtagattactgatgggtggtctttgggatagtgatgaggtccatggaatcaattcttgtgagtatgtagggtcagtgatgagggaatctggtgtcagtgatgggatgtgtgtggaatcaatctttgaaagccagatttgtggtgtcatctctcaggctgacacatcctgatctgtgtgtcagtggtggaaattctatggggtcagagtgtgactgtcaggtccctgacactgtgtgttctgggtctggccaagtgcacggattcccttgcctggtcctggctggagaggcccttctcaaggactcctcacatgaaaggtgggttggtggtgggttttgtttttgcttttgttttgtggtggaggtgggggtgggttggctttttctttagggtttagttttgtctcctagagaccacagacacatgcaacttttaggaagaaatttttgtctgggtggtcgctaggtcctttgggccaagccatctaatgggagtaaagctgaccattccctcagcgcggttcagatctagactgtcattttgaggtgtcctcaaggtggcgtgcaagtgggttgtggctttgagtggcaggtgtgtgggaagaaacaactaagaagacccaggagcgctcctagcctggatctgtcacagctggaagaacagcctccctgacccatcaggcgccaatgggaggtacctctgggctttgagaggctggtggaggtgggacctccagacctagagattctgggcacagaagcctgttactgccagaccctgaggcgttgccatgggatccaagggtgtttcaggtcagatcagagcctttctcagataattatttcggtaacttgtccagcgcacgctgctatgaaggcttaatgtgccgtctcccgcagtcttctttggtctgagagccacttgtttcttacatccctgtgctaatctcaccatctgctcctacataccccaggcatttgccacatgctggtcctctctttcctgacaggcgggacgtctctccagcttctgtgaggacaattcaaattatggaggagggggctgatgcagggcagcatgctgaggggagtaccgggcagttggaggagcaggggctcatttttctttgtagctcagattcctaagcctgtgactttgagtatcagtgtcttccttgcaaagtttcaatctgaggttcttggggagagtgcagaattggaacccgatggaagcctggtggggagaggggtggatggtgggaacatggagaatgtgtcaggttgtgtctattcctgacaccttactttgtctgttggagtttcccagtctgttccaaatgcactctctcgaccctgaagggacctgaggggggatgttggtcaccagtgtgtgctcccctggactcgattggaattggtcccacaaagtgttatttatttatttatttatttggagggagtctcgctctgtcacccaggctgcagtgcagtggggcaatctcagctcactgcaacctctgattcccaggttcaagtgattctcctgcttcagcctccctagtagctgggactacaggtgtccgccaccacaccttgctaatttttttatttttagtagagacagggtttcacaatgttggtcaggctggtctcgaactcctgaccaggtgatcgacccaccttggcctctcaaagtgctgggattacaggcgggagccatcacactccgccagtcccacaaagttaggcattatagtacattgctacttttgaatcacttattttttacttgtgtttttccccctccttttattgattgattgacacagagtctcactgtgtcacccaggctgaactgcagtggcacaatctcggttcattgcaacctctgcctcccgggttcaagcgattctcccacttcaaccttccaagtagctgggattacaggtgcatgccatcactcctggctaatttttgtattttcagtagagacagggtttcaccatgttggctaaactggcctcaaacttctgaccccaagtgatccacctgccttggcctcccaaagtgctgacataggcatgagcctcctttcccagacttccctccttttccttcagggattttaaatgttttctttcctccatctatttaataatatgtgattgccttgaggatttcaacttgaattaaaattacatatatttacctgtctttattaatattgaaacatattaaaataatacatgttcataatgaaaatgaaacattacaaattaatacacaggaaaggcagtattccccttccagttccacccttgaaataaccagttaacaagatgatgagcatctttccatgatgttctccaagagattcatataagtattggccagcaaacaacagaatatataggccaggcatggtggctcatgcctgtaatcccagcacttcgggagactgaagcaggtggatcttttgaggttaggagttcaagactaacctggacaacatggtgaaaccccattgctacaaaaaatacaaaaattatttggacgtggtggtgagcgccttaatcccagctacttgggaggtggaggtacaagaatctcttgaacccgggaggagaaggttgcagtgagccaatatcgcattactgcactccaacctgggtgacagactgagattccatctcaataaataagtaaatacataaaataaagagaaaaaaagaaagaaaaaagaaaaagaagaaagaaagaagaaagaaagaaagagaaagaaagaaagaaaaagaaagaaagaaagaaagaaagaaagaaagaaagaaagaaagaaagaaagaaagaaagagtgttcctatttctccacatcctctccagcacctgttgtttcctgactttttaatgattgccattctatctggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaattttgtttgagttcattgtagattctggatattagccctttgtcagataagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccgtcttgaattgatttttgttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcccacgtatgtttattgcagcattattcacaatagcaaagacttggaaccaacccaaatgtccaacaatgatagactggattaagaaaatgtggcacatatacaacatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgttgtggggtgggggaggggggagggatagcatgggagatatacctaatgctagatgacgagttagtgggtgcagtgcaccagcatggcacatgtatacatatgtaactaacctgcacaatgtacacatgtaccctaagacttaaagtataataaaaaaaaaaagaaaaagaaagaaagaaagaaagaaagaaagaaagaaagagaaagaaaggaagaaagaaagaaaaagagagaagtcttgtgctcaggttgctaagatcgatggtaagaacaaatcctctagcggtgaaaatgtaagaaggaaaaagaaatttctgttagtgttgtttgttgcaccccaagctctaaaaagtacagccacgtgtgtgataagtgcttagttaagatgaaaaaggcattaaatttgtgcgtggaaatcataaacagaaatgcgttctgattgacagcaattgggtcaatgctacccaagtttcagacatccactgcacgtctcctgcagataagggagggctactatataacgtttctttcttttttctttaattgtaaagcattctccttttttaatataacaattggccacatatatcactttagatataaagatattaggataccattatagtagataaaaagctaactcattctttgtaagagttaaagtatctttcattatatgagcatttaagatattaaagtacttttgccaccaaaaatagtgcttctgtaaatattcttttacttatatctctattaatttttacttctgctgaaacgaattgtatgagcaaacaagtgtatgtgtataaagtgtgatatatgtatatatatttaatatgtgtatatacaacttaatatatacacatacatacaaaaacatatacaatttttttgttttgttttttgagatggagttttgctctctcatccaggctggagtgcggtggcgtgatctcggctcactgcaacttccactgcttggttcaagtgatcctcctgcctcagcctcctgagtagctgggaatacaggcatctgccaccatgtccagctaactttgtttttttagtggagatgggttttcaccatgttggccaggctgctctcaaactcctgacctcaactgatccgcccaccttggcctccctaactgctggaattacaggcatgagccaccgtgcctgacctcaagtgatccacccaccttggcctcccaaaatgctggaattacaggcatgagccaccgtgcccagcctaacatatacaatttaatgtatatacaaatataggttgggtgcggtggctcactcctgtaatcctagcactttgggaagctaaggtaggggattgtttgaacgcaggagtttgaaatcagtctgggcaacgtggtgaaacccctatctgtacaaaaaacacaaaaaatagctggatgtacttgcaggtgcctgtggtcctagctactcaggagactgaggtgggaggatagctggagcctgagaggtcgaggctgcagtgagttgtgatcatgccactgcacccccagcgtgggtgacagagtgagaccctgtctcagacaaaaacaaaaacaaaccatatataatgtttatgtgctacacactcgatttctttccaaagggttatataacactgtaatttcaccagcaatatgtgtgactactcatttcctacgtatttgtgtgcagtcaagaaaacttagtaggcctgaattgtccaaacctcgcaaactccaaagaaaggtttgattctatcctagctcccaggaaataacttctaagtctttggaatctcctgcctatctgggagttaacaacatgatttattgtggggactttggaccatgcagtgtcagcttgaccttgggaagggtggagacagagaaactaatgtcatccaaatggctgctcttgtccatgtgaccaacttccagtaaaatcctcaacaccaaggctcaggtaagctttttgttggggagtatattctgtactttctgccacgtatcactgggtgaattaagcactgtccacatgatgccactgggagaggacaactggaagcttgtgctttgtctctcctggactttgccctaggcacctttttctgctgctgattttaatctgtatttttttgttgtaataaactgtgagtataacagcttcactcggttttgtgagtctttctaattaatcactaaacctttgggacctcagaacacaacattgtttcttttttttttttttttttttttttttttttgagacagagtctcgctctttcgcccaggctggagtgcagtggaacacaaccttgtttcttctttacttgaattttacatgttgtgtaagaaacctatgggcataactgaaaaatcacaaactaagaaagagctttccatgcagtctacccccctcaccctgtttcttcagtgctcccatgtctacttcctgaataaccaaatgtttaaattttctaaactatttctaatctatatatctgagtaattatctctgtgttatataataggtagatcctgctccttatcaatatatcaacttgatatattatctgatggcttcctcttctgatagctgatgacttggctgacactcaccccttaccccagtgcctggatcacttttcaaacatggtgctctcaccattttctttttcttttcttttcttttctttttctttttctttttctttttgagacaaagtattgctctgtcacccaggctagagggcagtggcatgatctcggctcactgcaacatccacctcccagattcaagtgattctcctgcctcagcctccagagtagctgagattacaggggcgcaccactacgcctggctaatttttgtagttttagtagagatggggtttcatcctctcagccaggctggtctcgaatgcctgacctcatgattcgcccatctcggcctcccaaattcctgggattacaggcatgagccaccgcacctggccactctcactattttcaatggctctcttggtcacctttcactcaggagagtatctgaggcaggagaatcgcttgaacccaggaggtggaggttgcaatgagctgagatggtgccattgcactgcagcctgggcaacaaaagtgaaactctgtcaaaaaaaaaaagcagaaaagaaaagaaagcaagctcttcctccatatacctgtaaggatcattgtcttaattttcttcatgtcttaacatgattcttgccttgtcaaagatcatcctatctgaaattgaaactatttacctcttgccttttttccacagcacttaaaacttttatttttgagatggagtctcactctgtcacccaggctgaagtgcattggtgtgatctcagctcactgcaacctccgcctcccgggttcaagtgattatcctgcctcagcctcccaagtagctgggattacaggcatctgccatcacgcctagctaactttttttttttgtattttagtagagacagggtttcaccatgttggccaggctggtcttgaactcctttcctcaggtgatcagaaccacttcggcctcccaaagtgttgggattacaggcgtgagccaccacacacagccctggctaatttttgtatttttagtggagacagggtttcaccatgttggccaggctgatctcgaactcctgacctcaagtgatctccctgcctcggcctcccaaattgttgggattacaggcatgagccactatgttcggacttctttttaacaaaccatctctgttcttatattatgtccactagaatgtaaacttgatgagagcaggagatattgtcaattttgttcaatgctatttatccctagagcctagaactgtaccatgcacatggtaaggagacaaatatttgttgaatgaatttattgagcagctgttctcagatttttggcctcagaaattctttactctctgtttctttactcctgacctgaggtgatctgcccacctcagcctcccaaaatgctaggattataggagtgagccaccacgcccagccgcccaactcatttttgtatgtttagtaggcacatggggttttgcaatgttggccaggctggtctcgaactcctgacctcaagtgatcccccacctcagcctccaaaagtgctgagattacaggcatgagccaccccacccgactaaataaaccaaaaactttagataagtgaatttggaggaaatatttataacagataaaatagacaaacagataattctaatttattgtctctctgccttaataaaatattagacaataccctaagaagaaagaaacaaaatctaaaaattcaccattcacaaacacaaatagttagaaaacaaagtcaaaacctaagaacatgttgaccacttatctgtcctctgaaatcggctcttaaatgtgttgaacatagattgacttgggattaggaaatttttaaaatattttttaaagtttcactttttggaattgaaaattaatccagattatgtaatatacaacatttggaatttaccaatcaatactctatcattttatttttcactcttcaaataatttcttgttcaagagtttaaaatgcttttaaaattaatagattctgcaggctatagtctgcagagactgtctccacaaaaaataaaaatatatatacttttaaaatatatataaaatatatatttatttaaatgtacatgttttaagtatataaaatatatttttaaaatttcattttttcaccggattgtatggtaagcatatgtttagtctggcaggaacttgcaaaactgccttctacagtggctgtcccactttgcattctcagcagaaatagagatgagttcctgtcgctccatatcttcaccagcatttggtgttggtgtttgcattcaagccagtctaatagatgtgtaatgatatcattgttttaatttgaatcccctagtgacatatggtgttgagcatcttttcagaggtctaagaaatgtgctgggcatggtggcagacacctgtggtcccagctactcaggaggctgaggtgggagcgttacttgagccctggaagttggggctgcattaagccatgattgcaccactgcactccagcctgagtgacagagctaaaccctgtctcaaaaagataaataaggccaggtgcagtggcccatgcctgtaatccaagcactttggaaggccaaggcgggtggatcacgaggtcagcagatcaagaccatcctggctaacacagtgaaaccccgtctgaactaaaagtacaaaaaaatagccaggcatggtggtgggtgcatgtaatcccaacttcttgggaggctgaggcaggagaatcgcttgaacccaggaggcagaggttgccatgagctgagatcacgccattgcactccagcctgggtgacagagtgagactccatctcaaaaaataaataaataataaataaataaataattgacttaatttttagaacagttgtaggtgtacagaaaaatagagcagaaggcatactgagctctaatatccgcctcatactatagtacacacactttctctattatcatcttgttaatgtggtacatttgttatgtctgatgagccaatattgatattattaagttcatggcttatattaagattcactctttgcgttctaccatttatggtctttgacaaatgcttaaggacatatattcaccattatagggtcacacagaaaagtttcactgccctaaaaatcttctgtgttccacctattcatccttccctccactcaagcccctggccaccactgaactttttataatagcatctgcctagttttgccttttctagtattccatataattggaactctacactatgtggcctttttgtattggcttctttcacttagaaatacgtgtttaagattcctccatgtcttttcatgccttggtagttcatttctttttattcctgaagaatattccattgtatgaatgtttcagagttagtttatccatttctctattgtaggatatcttggttacttccaatctttgtcaatttgttgtaaacattaatgtgcaggatttgagtgaatataagttttcaagtcatttgggtatataccaaagaatgcaattgccagatcgtatggtaagcctatgtttagttttgcaggaatttgcaaaactgccttccacagtggctgtaccactttgcatttgtggcaacaatcaatgagagttcctgtagctccacatcctcaccagcatttggtggtgtcagcatttggatttgagccagtctaatagatgtgtagtggtatctcatcattgttttaatttgaattctctagtgacatatggtgttgagcatcttttcagatgcttgtttttgctgcctatataacaaagggtagatacagatgatggacttcagggaaagagcttgctatgacgataggaagctgcaggcagagatgatctcagggttaactggacaccaactgtgccttctcctgtcacataaaatgtggtctacctaagttttgactggaaacacagactatctggttgtccataaatatttctaactgaggcttaaggtttatgcatgtttcgaccaaaaggtgataccaccccaatatataagcaggtcggggtacaacaggtaatgactgtcagagatgttgagagtctacattgaatggtgtcactggctgcccatgcctttctcattaaggactttcacttttcatttgccacatgaaaggccactgagttaggctacatcttattttttctcttgagaatctctagtactgagaaatttttgcattctgggctacactgggttcataatctgactatatatattgtgtgtgtgtttgttccttccctaaaatgctcagttcagctgcagttctagaggtaaatactactaggtttccattttagagagttgaagatctgaggtctggagaggttagtgtgtagaaagttatgtttaataagtggcaagaccatgtggccaggtcagataagctgccttcagattttactctcgaacttctactggataatgtcttttcattatagaaaagaaaagagggaacttagatgtttttttcaaaatcattgactatagaatttctttcaagatatgatgaaaagcaataattgtctcattttatattacctataattattgctcaccagaaattgattatcgatgcagcaatcttttacgttcctgtctgctttattatgcatggccgggcttcattgtaaataagagatccaagattcagaaatatctttaacttgcaatgcttggtcacaggtatccatctgaaaaatattttgctcattagccatatggactcatatggtaaactacagccagagactcaaaatgtggaaaggagaaagggctatcagaagtcctgtgtctccttacattttgtgtttctattcatatgtatctagaatcatgagaaatttgagcaaatgggaaatgcaaagtcctagtccatgcatacccacatttcagttatctgcattattgcacatttaaatttataatgcatacataggatacaattcaataggtataaaaatgttaagtaatcttttctctcatgcaccccagtcattcagtgctcacttttgagtcagcattttaattctgttgtgcatactttcataattttttttttatctttttttttttttttttttgaggcagagtcttgctctgttgcccaggctggagtgcagtggcatgatctcggctcactgcaacctctgccttattgattcaagagattctcctgcctcagcctcctgagtagctgggattacaggcacgtgccaccacgcctggctaattttttgtatttttagtagagtcggagtttcactgtgttagccaggctgaacttgaacaactgacctcataatcttcccgcctcagcctcccaaagagctgaaattacaggtgtgagccaccacttccagccttctattcctttatatgtgaaaatcattttaacattccacatataagtaaggtcatgcaatatttttctttctgtgtttggccaacttcacttggtataatgccctccagtttcatccatgttgtggcaaatggaaagatcttgtacttttttagggctgaacacagaagttattttcatgtacaaggttgcagttgccatacacacaaatatgtatgtatgtgtcatagtcatatacaattttaaatacatatatgtgttctatgcatatataagtatttctctattttcacagaaatgtcagtctaaatcagtacctagggagggtcattgttttcttaatctacaaatcaagacaaagtatgagtggctgcaccctagtttaataagtcctctattattgaggatgttttcctgtttccttttgtcattgttgttgttgttttgttttgagacagagttccactcttttgtatgaagtggtgtgatctcagctcgctgtagcctcccgagtagctgggattataggtgcccgccaccacacccagctaatttttgtatttttagtagagacagggttttaccatgttggccaggctggtctgaactcctgacctcaggtgattcgtccaccttggcctcccaaaatgctgagattgcaggcatgagccaccgcacttggctgctttcaccatttcagactgagcttggagaagaacctgaagaaaaacatgactttaaaattttgatgaatggagaaatatctttccattcaccttcctttcctctatttcattcttattttaaaatatacaaacaaagatatggatacatcagttattaaagaaacatctatgtgatacctatccaggtgaagaaatagagcactatcaccactgagaagtcctctgtatgcccctaactgatcctaaagtcttccttccccttattagtaacagatacaacagatatccacattacctgtgggtatctgccatcctctccttggttctctttataattttattatgtattttctttcttttttttttttggagatggagcctcactctgtctcccaggctggagagtagtggcatgatcttgactcactgcaacctctgcctcctgtattcaagtgattctcatgcctcaacctcccaagtagctgggattacaggcatgggccatgtgccaccatgcctggctaatttttgtatttgtagtagagatggagttttgcatgttggtcaggctggtttcaaactcctgacctcagtgcctggccttattatgcatttttatatgcctaaattaaagtctgattttgcctggtttttctcttacataattggagtaaaagtctgtatcctcgtgcatttggccccttttactcaatattaagtatttaagattcacagtgagcattgtttctgcattctattaaaacagtacaccagccaggcatgatggctcatgcctataatcccagcactttgggaggccaaggcaggcagatcacttgaggtaaggagttccagaccaccctagccaacatggtgaaactccgtctctaataaaactacaaaaattaggccacattgtggctaatgactgtaatctcagcactttgggaggccaaggcaggtggatcacacggtcaggagatggagacaatcctggcaaacatggcgaaaccacatctctactaaaaatacaaaaaattagctgggtgtggtggcacacgcctatagtctcagctactcgggaggctgaggctgaagaatcacttgaatctgggaggcagaggttgcagtgagccaagtttgagccactgcactccagcctcggtgacagaacgagattctgttaaaaaaaaaattagccaggtgtggtggtgtgcacctgtaatcccaattattcgagaggctgaggcaggagaatcagttgaacctgggaggtagtggaggttgcagtgagccaagattgtgccctgtactccaacctgggcaatagagtgacagtctcaaaaaaaaaaaaaagcccaggcccagtggctcccacctgtaatcccagcactttgggagtctgagacaggtgcatcacctcaggacaggagtttgagaccacccttaccaacaagggtaaaccccctctctactagaaatacaaaaatttactgggagtggcggcgtatgcctgtaatcccagctactcgggaggctgagacaggagaattgcttgaacccgggaagcagaggttacagtgagccgagatcgcaccactgcactccaacctgggtgactaagcaagacgctgtctcaaaaatatatatataaatttatatttatatacataaaataaatataaaaaaaataagtaaaaataccgtacaccagtgtgtatcccttcattgttggtggacatgtgggttgtgttcatttttgtcagttacaaatgatgctgttgtgaacatgtttgtatttctatttggttaccattagtgtgtatttatgtacagtataaagcaagaggtgaaaccataggttacagggtaaacatatcgtcagttttaccaggtattattggtttcatcccaatgttaacacaccaactgtcagtcttacaatgtctgataattcccaaatctttgcattcttcttgacatttaattttgtcaaaattttaatttgagtcttttggtgggtatgtggtgatgattgtgatattaatttactgggccttttcttctctgtaacaggccctgtcaagatatatgtgtggtgtggcaggggtaggagcccctagaggtagcatgggctctggaatccttaatcatcctatgtgaaaaagttgatggggcagtgatttttctttctttctttttttttggggggggggacagagtttcgctcttgttgcccaggctggtgtgcaatggcatgatctcagctcactgcaacctccgcctcccaagttcaagtgattctcctgcctcagcctcccaagtagctgggattagaggcatgtgccaccacacccagctaattttttttatttagtagagatggggtttcaccatgtttgtcaggctggtcttgaactcctgacctcaggtgatccacccacctcagccccctaaagtgctgggattacaggcatgcaccactgcaccctaatatttcctgggtgcagtgttgtagccagggtgcaaagccacttaatgattctgtcatccaaatattatatcttctcccttccccttgagatatgctcattcccccatacaattaaagaatctcaattactcttgaaggggcataaaatcctctctgtctaatcatgggtccttccaaattatttgttggctgtgtttaaaatatgaaaaagagaatgtagattttgttttcttctttctgcttaacctgaacaaaatgtcatagatacctcttaacctgttgctaaaccaaggagagtcacttgaataatgaacaagactggagggacgccacatggataatttatcattacactatcatcacatacatggaactcatcaatgaagcttatgaaaaaaattgagtcatttgtggaaaagtgtaaagagaatataggagatgtctcaagtgaagagaaaaaagctgcagaaaagaattacaaaaaaagagtgttaagatgcaaacacaaattcagagattcaggagcacaaagggctaagttaagggaaaaaagagttaccaatattttcttattcattatggagagcaggatgaattctttaaaggtcaaataattgtgagtctgatatatctgatgataatttgtatttctaatgttgtaaatggttgtgaatttatggtcattattcctgtttcctttagactagtgaccatgagtttgattgacaaaaacccattgggttagtattgttatctatgtgtgttcatcatgctatgtgttaaaataagtccatcaatttttatcttgtgtttgttttcatttcattttagtttaggttctttgggacagggtcttactctgtcgcccaagctggatgtgcagtagcaagatcacagctcactgcagcctctacatctccaggctcaggtgatcctcctacttcagcctcccaagtagcagggactacaggcatgagccaccgcacctggctaatttttgtattttttgtagagatggggttttgatatgttgctcaggctggtctcaaactcttggactcaagtgatctgcccaccttggcctcccaaagtgctgggatgactggcatgtaccactgtccccgacctgttttcattttattaattggctgattcatttagacacataatcatcaagtcaaatctcactctttccttagcatttcccttcagtttagcttagaatatctattcctattttaaaacacatatgattattcaagtgtggtggcacatgcctgtaatcctagctactcaggaggctgaggcaggagtatcacttgaacctgggagagtgaggttgcagtcagtcgagatcgccccactacactccagcctggatgacagagtgagactccatctcaaaaaaacaaaacaaaacaaaacaaaacaaaatgttttctccagatcatttttacatttaattattcagtctgctttaactataccttaatgtaaaaaattcagtaaatttaactcctacacactattagttaatgtacctaacacggtttattgaataagccagtccattcccaacagcatcaaaagtaattacatttcccaatgtaaattaatacagccattatggaaaataatatggagattcatcagaaactaaaaatagaattactgtatgttccagcaatccctcctgtggttgtatagctaaaggaattgaaatcagcaaactgaaaagataactgcactaccatattcactgcagcattattcataatagctaagatatggaagcaacgtaggaggccagcattggatgaatggataaagaaaatgtgatatatgtacacacacacacacacacataaaggaatactatccactctttattttatttatttattttttatttattttatttcattttattttggacgtagtttcactcttgttgcccaggctggagtgcaatggcatgatcttggctcactgcaacctccacctcctgggttcaagcgattctcctacctcatcctctcaggtagttgggattacaggcatgcaccaacaagcctggctaattttgtatttttagtagagacaggtttcctccatgtatgtcaggctggtctccaaatcccgacctcaggtgatcagcccacctcagcctcccaaagtgctaggattacaggcatgagccaccatgcccgatcttactatttgctctttatctttcctttgagatgaagtttccctcttgttgcccaggctgaagtgcaatggtgcgatctcagctcactgcaacctctgcctcccaggttcaaatgattctcctgcctcagcctcccaagtagctgggattacaggcacccgccaccatgcccagctaatttttgtatttttagtaaagagggggtttcacaatgttgctcaggcttgtctcaaacacctgagcttgagtgatccaccggtctcaggctctgaaaatgctgggattacaggcgtgagccacggcacccagccaaaaacacagatgagtgtattaatagtctgaagcactgtaaaatattgctgagaaaacagatcactaatatcatcattacagagcacaaaataagttctgctattattaggaatatcatagctctgactaacacatacttggaaaactcattctattagaaattaaattatactaatactattgacaatcacttttatagttgtcattgcaaactcaaagacaagaagtaaattcatcaccagaaaacataaaacaagtacttagccttactgctgagaagcctgtaattgcattttactgaatggcacctcagttcttgggataaaatttgaaacggcaactggaaggacagctttaactttaaaatggttttatttttagggttgtcatgttgtaaaagctattctcacatagctaagctgttggaaagagaccaggttttgtgaaagtttttcatcagatgtttcacgttgtcctcactgcaacctcaaacagtggcaaatgctttgtaagctgctgtaatgcaaactcagctgataaattaataaaattctgtttctttaggccgggcacggtgactcacatctgtaatcccagcactttgggaggccgaggcgggcggatcacgagatcaggagattgagaccattgtggctaacacggtgaaaccccatctgtactaaaaatacaaaacattagccgggcgtggtggcatgcatctgtaatcccagctacttgggaggctgaggcaggagaatcgcttgaacctgggaggcagaggttgcagtgagccaagattgcacaactgcactccagcctgggggacagagagactccgtctcaaaaaaataataatgaaaaatgaataaataaaattaaaaaaataaaattctccttctttaatgtcctaagccagaaaatatttgttaacattgctaacaggaatgaatggacgtgaatggaccacccaaagattctcctatttcagggtcaacttcaaagagaaaacatcaatttcacagtgtttcttgcttacccaggtcaagagttaccaatatcaagacatccaactgcacagagattggacctagagcagcaggagggcgtatacaaatcacagataccagacggaattgcgagagggagcagaaaaatgattcatctgtatcaggtgtggtctgcaagttgtaggatgtagaatatagcttgtggataaagagaattagaaaaaattaatgcccattcaagtttattttatgaactagccaaaagtcgcacatggatattcacagtaggtagaatgattagagcagaagtagcacttttggcacatagttattgggattgaaggggaattcattttagctttaactttaaaatagatttaattacttttattttaattaattattctaaagcttttaattttaaaaaagtttgtaatttttattttggcaaaatatacatagcataaaatttgccattttaaccatttttaagtgcatagttcagtgtcactaaatacagtcacctgattgtacaaccatcaccaccatccatcatctctagaagtttttctttttcagtttcccaaactgaaactctgcattctttaaacaatagcccttccttaatctcttttcccattaactgggaaccttcattctacttttggtttctatgaatattacatgctacatacctcatataagtggaatcaggcagtattagttttttgtatccagcttctttcacttagcattatgtcaaaatccatccatgctgtagcatgcgtccaaatgtccctttttaatgctaagtaatattccactgtatatctgtaccacattttgtttatccattcctctgtcaatgaatgcttccaccttttggctatcatgaataatgttactatgcacatgaatttgcaaatatctgttgaagtccctgctttcaattcttgtgggtttaaacccagaagtggacttgctgactcatatggtaattctatgtttcatttttatttatttatttatttatttatttatttatttatttatttgagatggagtctggctctgtcacccaggctggagtgcagtcgtgtgatctcagctcactgcgaccccccacctcccaggttcaagggattctgctgcctcagcctcctgagtagctgggattataggcacacagcaccacacccagctaatttttgtatttttagttgagatggggtttcaccatgttggtcaggctgatcttgaactcctgacctcgtgatctggccacctcgttgtcctaaagtgctgggattacaggcatgagccactgagcccagcctatgttccatttttttaaaatttaggaactgctgtactcttttccaccatgactataccactgtagagtccaccggtaatgcacaagagtttcgatttggctacatcctcaccaacacttattattccctggttttttgatgattgccatcttaatgggtatgaagtgctatcttattatggttttgatttgcttttccttagtaatcagtgatgttgagcatctttcatgggcttgatggccagttgtatatcttttttgggaaaatttctatgtaagtcctttgcctattttttaattgggttgtttatttattgctgagttgtaggagttctttatatattctggatattggtcccttatcaaagatattatttaaaatattttcttccattctgccggttgtcctctgattgcacaaaagttttaaattttgatgaagtccaatttacttatttttttgttttgttacttatgcttttggtgtcagaaagcttttagtttataattttaaatatattacgtctcctgcctcataagtaccactggacaaggtcccttttatgtactcagcttctgtcagaggtaaatgtattttgaagtggaggacaaagataattgcacaattggcatggagaactaaggtaattatgaaagttccagatacaaagagagagagctcaatatgccagcagttctctaccaatccatcctagaggtcttctcttgggattgcctaaataatgcaggggatggttgcaagatacacaagtgttccagaagcgtgtaaacaaggtacagagaaaaggatgagataaaataagatgatataagatattaggaaagccttgttcagaagattgcctacagaggcaaaagggacagtttcattttgctgagggaaacagggtggtaagaacacttgtggggaagacccccacttaccctgatacagagagaagctgtaaaataacttaatgggagagcattaggctgagatagttcccatggcctgggttcctacataggcaaaatgaaaagcttagcccatcaacaagtggcccgctgagtattagctgtgtaatgagagacctaccaccaggatacttcaaataatgcaactgcccaaatttttgccaatcaaataatttctctactctacttctatattcaccctataaaagccttccctacaaacacctccagtagatcctccaaccactttcagtttggagctgcctgatccatgaatctctgtttgctcaaataaactctttaaaaatttaatatgcttaagtttatctatttttttctcatttttaaaaattgaaatgggatcttcctgtgttgttcagcctggtcttaaactcctgaactcaagggattcacctgtctcagcctcctgagtagctggaattatagacgtgtgcctccacacccagcttacatttatctttaaacaagggtttgacccctttctgaaatatatttgtgtgaagacctgtaccctcagtgatatggcaagctcattttagaccatcgagcacttttgtctctggaccacaatttgccctttgtgacctgctctcctaaaaaattcaagtgtaattcaagttagtttaccctctgctgatcaggggaggttgatctaggtgcaagttcaagacaggcactcactccttcattcataccccaaatctcagcatcacacaatacacccatgtaataaacctgcacaggtaccctccagaatctaaaatgaaagttgaaattcattaaaattgtaatttcatcttattaaaaaacaaagataaatttgcttctttccaattttgatatatattatactgacatacacactgtattctatggtgaattatatcgattgaatttcacattttaaactaacactgagttactttgagaaactctgttgggtcataatgtgttatgtttttaatatattttaatacaatttgcaaaaattctgttttaaaattacatctatgttccataaataaataaatatgtaaaaaataataaatgtttatattattcaagtgaagattatagcgatctttttgaatatctacttaacctcagctagctttaaattcagaagtagcaactccatagaaattcaacttatttctaccttattactcatacttgtctccttgaagaagcttcattgctgtcatccagtttagactgggatgtcataaatctctagactgagtagtataatattcactattaaaataaaatcaaattattattataatgttatgacacctccaaatacaaaaagcaagcccatggatgttaggttaaggtatagagacaagtattcctacttactatcttttagggcagacatatcccagccaaggtgattgcaaaatgaaatggaaactatatggtggaaggggacttgagactcacacagattggattttcattccaaccctcacatacacaagctgcatgactctgggttgattgcatattctcttagattttcaatttcttcgtctgtacaatggaggttaatgcctatgggctacggctgatgtggggataaaagaaccaacagggatgcatgggcagggcctggtccatggagcagctggcatcaacaaatggaagctccttcccatcttgtatttgtgtgcactacaaaatccggaatatgtgggtataaaaagtacctttataagagacataattggaaacttttgcaaaaagagtttggaaaggtgtcacatcttgtggcatgaggagttgtgggcatacacttgaactttgtgctgtgagatatccacagaacttcagtagcttaagagaacagtttagatgtcatcttattcatctaccatagaacttcctctttttttctgagatttctagacaataacttttacagctctaataatgcagttctctcccagttgtttggactattctaatagatacaaagcagtatttcaccagcagatgctactgcagtttgtatgatgatttcaaactaagaatccatttaaagttatgcaatacttttttggaaatagagtgaaagtactttaagtttaaaatcctataaaataggtttacagtaaataattatctgttgcaatgtctatcatactatcttatattcacacatgtgttggtgtcctaatacatatgtatgagagtgaaagttacctgaggtcagagactctgccatatgttccctgcaccactgttgcctatctcagcacatgatatacagtagatgctcaataaatactttaacttaaaaaatgcactaagaataaatcttattagacatcaaaatatgtacgagtacaatctagggacatggtcaggggctcaaaattcaatcttatttatttatttacttatttatttgtttatttggagacagagtctcactctgtcacccaggctggagtgcagtggcacgatcttggcttactgcaaccttcgtctccccggttcaagcgattctcctgcctcattctccagagtagctgggattacaggtgcacaccaacacacctggctatttttttttcgtatttttaatagacagagggtttcaccattttggccaggctggtctcaaactcctgagctcaggcagtctgcccacctttgtctcccaaaatgctgggattacaggtgtcagccaccacacagccacaaaatgttttaaagtagcttcaaaagccctttgcaaataggtgttttcataacaagatgaaaacaagaaaacattgagcttcatataatagaagggttctgcctggatttgcatgtggccccatcatttgtttgctgttgggccatggtcaggttacttagctgctctctgcctccacataggctttatgcctgtgcatccttcatctacaaaatgggaataataagaacatctaacaattagaagtggagaaaatatatgtaaaggtctttgaaaagagcttgtcaaagctcaataattgtcagctatcattcaataataatcataatcataaaaatatatgactcaaagaaagattgctacctcatatccagcttccccaaagaatatcagacattggacctgtgaaaggaatgacattgagatgtattttcacatcgctaagttggttttttctctttgccattcaatttctgcagtccccactctaagtccatggtccacctttttatttttcctcctaaaatgtcttcacttcttgtaaaatttacttttccttaaaaagggcccttttcatcctctcactcttttgcccttcccagaagttggttaatgggcccaaaaatacagttagatggaaagaacagaagaatttctagtgttcaatagcacagtagggtgatgatcattaacaataacttatatatttcaaaatgactagaggaaagatgtggaatgttctcaacacaaataaatgataaatgtttgaggtgatggatatgcaaattatcctgatttgatcactacatattgtatgcatgtatcaaaatatcacatgtaccctagaaatatgtatcattgtcatgtatcaataaaaacagaaaggcctatttctctttccttcctccccgcattccctgctgccccagatatgtgttgttcctggtgctctcctaccccacgttcagtcagcactgagccagcaggaaggatctcacagatcatatcctgagatcaaccctttcaggtaataatcctcctgcttttagtcatttatatcctttggttcgtatatattttgagtcaaatgccttctaactactgacttacataatatcccttggtttttaaagataatacaaagtggattttagtaacaatcttgagtcgtcacagaagctaatgaagttggggatgccatgaagccatccaagcatatagagcccatttccctgggtcccttttccttagctcaaggccacaaaaaatcagaacttgaattccagcccacatttgcattatgtctaaataactatgagttataaatgaagctaacagttaaatatattctattctcctacttcgataaatataccgccataattacccacaacgtcaaagtcgagtgtagaattctctgatttcttggtgctctgcacgggaatgtggtagtaaagggagagctgatcctcagccccaagctaaacttttttctttcatcgtagctagccctgtactctcttgagaagccttgtgtacccctgtatgggggactccctaggccccatgcaagctccatccacaattctcaccccttcagacagcagagccttgggcaccatttggacaagcacagtttgcgctttgaaatggacccagagaagaggccatgcaggctcagacacatttggccaggagcctgagtccccagtgtgtgccctagaagagagggtgagagctctgggtgggccagggtacagtcagtggagggccagagaggcaccttctcaagcgcaggattcagggcaggagtcctcttgcccagatggaaggctatgactgcttagtgcaatggcgcctgcgtcatgtcttctcagttcacctttcattcagtctctgccaccgtgggaagttccatggaagcgcaggcttcccttgtgctgccagccaactcaaactacactttctgccttagggcatctccattattgtaggatttttcctgagcacaaatacagcccagaaacacttgcaggttaacagcctcaggggaagacctcaaccagtgtgggacaggtgggcaaatgctccaggctcatgtttcaggtggacagttctggataactttctggagcctctcagaaggtcctgcagaaaaaactgcatggcaggagcctcaatagcaagccattattttgacttttctttcttgcctgtctcactcttcccacttctgactcctgcttcttggaatcacttcccaaataaaccacccacacccaagtccttactccagctctgcttttagggatacagacacaccttggagatattacacgttctaggtaaccacaatagggcgaatatcacaacagtgcaagtcacacgaaattttttgcaagtcacacaaaattttttgctttctggtgcatataaaagttatgttgccaggcatggcggctcatgcctgtaatcccagcacattgggaggccgaggtgtgtgcatcacctgaggtcagaagttcgagaccagcctgaccaacatggtgaaaccctgtgcctaccataaatacaaaaatggtggtgcgtgcctgtagtcccagctactcaggaggctgaggcaggagaattgtttgaacctgggaggcagagtttgcagtgagccaagattgcaccactgcactccgacctgggaaacagagccagacaccgtctcaaaaaaaagttatgtttaaactactgtagtcaattaagtgtgcaatagcattatgtctaaaatacaatgtatataccttactttgaaaatatgtgattgccaaaaaatgctaaccatcatctgggccttcagcaagtcatcattttgctgctggatggtcttgcctcaatgttgatagctactgactgatcggggtggtggttgctgagggctggagagggagtggcgatttcttaaaataagatgacaatgaagtttgcgcattgactgactctttctttcacaaaagatttcactgtagcatgctatgcagtttggtagcattttacccacagtagaatttatatcaaaattgcaaccaatcctctcaaaccctgccactcctctatcaactaagtttatggaatattctaagtcctttgttgttctttccacaatgttcacagcatcttcaccaggagtagattccatcccaagaaaccaatttctttgctcattcataacaagcaataataatacattattttatacataatatatataattatataatatacatattatatatttattatattatatattataatatatataatatgctataatatataatatgtaatataatataagcaaaaataatatcgcttggtttttaaagataatacaaagtggattttagtaacaatcttgagtcatcatagaagctaaagaatttggggattccatgaagccatccaagcatataaagcctattcccctgggtcgcttttccttagctcaaggccacaaaaaatcagaacaagaattccagcccacatttgcattatgtccaaataattatgagttataaatgaagctaacaaatagttaaatatgttctattctcctacttcaataaatatactgccataataacccacaaggccaaagtcgagtgtagaattctgattccttggtgctctgcacaggaatgtggtagtaaagggagagccgatcctgagccccaggctaaacttttttccatctaattccatttatttccattaagattgcagcaattcggccaggcacggtggttcatgcctgtaatcccaggctgaggcggacggatcatctgaggttgggagttcaagaccagactaaccaacatggtgaaacaccatgtctactaaaaatagagaattagccagatgtggtggcacatgcctataatgccagctactcaggaggctgagacaggagaatcacttgaacccaggaggcggaggttgtggtgagctgagatcatgccattgcactccagcctgggcaacaagagcaaaactccatctcaaaaaaaaaaaaaaaaaaaagattgcagcagttcactcacatcttcaggctccacttgtaattctagttctcttgctatcttcaccacaactgtggttacttcctctgctaaggtcttgaacccctcaaagtcatttatgagggtcagaatcaacttcttacaaactcctattaatgctgctatttttacctcctctggtgaatcataaatgttcttagtggcatctaccatagtgaatcctttccagaaggtttccaattgactttgcccagatccatcaaaggaatcatgacctatggcagtaacagccttataaaatatatttctcaaataataagacttgaaagtcaaaatgatgcctcaatccattgactacagaatagatgttgtgttggcaggcatgaaaccagcatgcgtttccctgtacatctccattagagctctttagtcaccaggtacattgtcaaaaagctgaagtatttgaaatgaatcttttttctgagctgtaggtctcaacagtgggattaaaatactcagtaacccatgtggtaaacagctctgatatcatccaagtgttgttgttccatttatagagcacaggtagagtagatttagcgtaattcttaagaggtgtcctaggatttatggaatggcaaataagcattggcttgtaacaagaaagtcagcctgtcctttaaatcttttttatttttcttgagataatgtctcactccattgcccaggctggattgcagtggcatgatcttggcccactccagacttgacctccttggctccacaatcctcccgcctcagcctcctgagtagctgggactagtagcatgcaccaccatacatggcttatttttatttatttattttgttagagacagggttcaccatgttgcccaggctggtctcaaactcctaagctcaagccattctcccacttcagcctcccagagtgctgggattacaggcatgatccaccctgcatggcctctaaattcgtgttatggagactcattttcatggttaaaatatcctgaattgactgtggcctgttgggaggtgggatggagggagctacttaaggaaaatgaaaaagaaagggaagcacaccagaagcaagaaagtgtcatcaatttttacatcaaggactccatgataaagagaaagtacaggtggcctgttatcatggctgaccattggactgtggactgcacctgcatctaccaggttcttctggataatcccagttttaaatttttgacctgatattcatgaacacagtgctactggtcagacctttgtccaggtttaagcttcagaacataatgtcttcatgcagtgggaggcctggttagggttatgattctgccctgggacatctgccccttctgacctggaggtaaatttgtcatctactatttacctccacacttgaacagccaatgatgggctgagcacagaggctcacatctgtaactctagcactttgggaagccaaggcaggaggatcgcttgaggccagtagttcaagaccagcatgggtaatatagtgagacctggtctctgtaaaaacaaacaaacaaacaaaaccaaggatggtgggtggcagggagcagttcaacatgggaaaccattaacctgagagctagaaggacccttaggccagcccccattaatagatgagactctgccctgagattatagtccaaggtaatgcattgagcttttctagaaatttgaaaataatcaatcctaaaacccccaagcatactgctattgtttgctattgaataatgttttctagtctgggtgtggtggcacctgcctgtaatcccaacactttggaagatccaggcaagtggatcacctgaggtcaggagttcgagatcagcctggccaacatggtgaatccccgtctctacaaaattacaaaaaattagcaagccatggtggtgcatgctggtaatcccagcttcttgggaggctgaggcaggagaatcctttgaacctgggaggcagaggttgcagtgagatgagatcatgccattgcactccagcctggactacagagacaaattccatctcaaaaataataataataatgttttctacaagcaaggggttactttatactgggaactggtgtgaagggattcaccatgtgtaagcttttggattgatgacagttatttctagatcatggaggtgggaatgcttgttgatcatcttctatgttctttgttatattgattgattttttaaattagcatttttataacaataaagtcataaaaacaagtaactaaaataaagtaaaataatctaaaaaggccaagcatggtggctcatgactgtaatccaagcactttgggaggctgaggtgggtggatcacctgaggtcaggagtttgagaccagcctggccaacatggtgaaacctcatctctactgaaaatacaaaaactagccgggtgtggtggcaggcacctgtaatcccagctactcgggaggttgaggcaggagaatcacttgaacccaggagaagctgcttgcagtgagctgagattgcaccattgcactccagcctgggtgacaagagctaaactctgtctcaaaacaaaacaaaacaaaacaaaaatctaaatgtaattgagttgaatatttaaacttttaactgacatttcaaattagattctaattccatttaaaagagcatctcatagaagcaaatgtactcaattatattaactctgtggtttcatttaagcaatttgttttgtgaagggacacaaatccaaccagattttaacagtgtataaatatgtatttattaatttaattacaatgacaatactctcaactccccatttgaataaaggagagcgtgtgatctgtgttctgagacagtgtgcactataggtgtgtggaaataccgatgccctcagctgtgtggtaggctcagtgggacctggagtgcaggagcccctgggccattcacctctggccacaaaagtcattgctcatttacacccaacttctatagaaatattattttcagtggttgttatgatgcaaaagaaaagaagcagggagatttattaaactgttacatataagttatgttagtaaataaagtctactttcttctggcttaactaaaaatctatactagtatttatgtcttttggaaattagagatgccaatttaagtattatgaagcaaagcaactgattattaggtaagacagccaagtacaactgcagaattgtagaggttatgggttacatgtataagaatatttcatagcaaaaatcttttaagactctgtgaagacactccacagtgaagcagaaattagaacagaattaataatactgtgtatgctctcagttcaccaatttatcaaaactagctttatgattcagaagggtgtctgcacttttgcaattggaagaaaagaaagaatattttattttttgactctttagattttcttcactaacagtatttccaaggctaagtaagggagttgcaagtaacaccaagagaaaaaagcagtcttgagcagctttttaaaaatagtcttaaaatatggaaaatgaagccaggtgtggtggctcactcttgtgatcccaacactttgggagcctgaagtgggagggttgcttgaggacaaaagtttgagacaagcctgggtagcatagcaagatccccatcattgcaaaaaataataattttaaaaaaaattatctggatgtggtggtgcatgccttagagtcccagttacttgggaggatgaggtaggaggagctcttgagcctaggagttcaagtctgcagtgagctatgattgcaccacagtcctcaagcctgggcaacaaagtgagactctctctctctctctctctctttatatatatttatatatatataatatgtggaacccatatatatatggaaaagggaaggggccaagaatatcaaagacattattgaagaagaggaaagattcgtcctgccaaatatcagaacttttataaagctacaacaattaagacagtgtggtcttcactgataaactgactaatgaaacagaatagagagctcccaagcaaatctccacaaatttaatcttcgatatgtgatgtaggtgacatggcagatcagcaaggaaagaaaggacttttcaataaataggatagaaaaataatggttattgatgtaggaaacaaaatgaaattatattcctacttcactctatatacaaacattaaattccagatggacagaagacttacatgtcagaaacaaaactttaaaacttttagtagaaaatgtaagtgaatgagacacaaaaagccacttaacaattaaaaaagattagacattttgactatcacaaaattaagaactttttacatcaaaattggaaagatagtctgggcatggtgtctcaaacctgtaatcccaacagtagatcacctgaggtcaggagtttgaaaccaggctggccaacatggtggaacctcatctctactaaaaatacaagaaattagccaggcattagtggcagacacctgtaatctcagctacttgggaagctgaggcacaagaatcgtctgaacccgggaggtggaggttgcagtgagccactgcactccagcctgaataacagagtaagactctgtctcaaaaaaaaaaaaaaatagaaattaaaaaataaaagtaaaaaagtgaaaagataaactataaattagaagaagttatttgcagtacctaaaacctacaaaaggttaatatcatatcaactaagtgctcatatgaattatttttgaataaggagctcctatgaattaattttaaaaatagcaaaccaacagaaaattgggaaaaggcattaatagggatttcacaaaagagaaagcccacaaaatataaaaattttctcaacctcattagtaatcagaaaaatgcccaagatactacacatctattctctccacaaatattgagaagtttgatgataccaaatgtattagtccatattcacactgctgataaagacatacctgagatggggaagaaaaagaggcttaattggtttaagggctccacatggctgaggaagcctcagagttatggtggtggatgaacagcacttcttacatggcagtgacaagagaatatgagaaggaagcaaaataagcaaaaaacccatcagatcttgtgagatttattcactatcacaagaatagcatgggaaagactggccccaaagattcaactacctccccctgggtccctccccgaacacatgggcatcctgagcaatacaattcaagttgagacttgggtagggacatagccaaaccatattattctgcccctggcccctccaaatctcatgtcctcacatttcaaaacctatcatgccttcccaacagtcccccaaagtcttaactcatttcagcattaacccaaatgtctgctgtccaaagtctcatctgaaacaaggcaagtctcttctgcttatgaccctgtaaaatccaaatcaagctagttacttcctagatacaatgggggtacagatagttgagaaaatacagctgttccaaatgggagtaattgtccaaaacaaaggggttacaggccctgtgcaagcccaaaatccagcaaggtagttaaattttaaagctccaaaatgatctcctttgactccatgtttcacatcaaggtcatgctgatgcaagaggtgggctcccacagccttgggtagttctgcccctgtggctttgcagggtataacccacctcctggctgttttcatgggctgatgtcgagtgtccgcagctttcccaggctcatggtgcaagttgtcagtgaatctacaattctggggtctggaggagtgtggccctctcctcaaagctccacgaggaagtaccccagtagggactctgtgtaggggcttcaaccccacatttcctttctgcacagccctagcagaggttctccatcagagcatcacccctgcagcaaatttttgtttggacatccaggtgttttcatacatcctctgaaatctaggtggaggtttccaaacctcaattcttgacttctatgcatgtgcagactcagcacaacgtggaagctaccaaggcttggtgcttgcactctcaaggccatggcctgagttctatgttggcccctttcagccatggttggaggggctgaaacacagagaaacaaggctctatgctacacacagcacagggaacccggcccagcccagaaaaccattttttcctcctaggcctccaggcttgtgatgggaggggctgctgtgatgacctgtgacatctcctgtagacattttccccattgttttggggattaacattcagcttctcgttacttatgcaaatttctgccaacagctggaatttatcctcagaaaatgggattttcttctctatcacattgtcaggctgcaaattttccaaatttatatgctctgctttctttataaaactgaaggcctttaatatcacccaagtcacctctggaatgctttactgcttagaaatttcttccagcagataccctaaattatcactctcaagttcaaagttccacaaatctctagggcaggggcaaaatgctgccattctctttgctaaaacacaacaagagtcacctttgctccagttcacaacaagttcctcatctccatctgagactacctcagcctggaccttattgttcaaaacactatcagcatttttgtcaaagccattcagcaagtctctaggaggttccaaattttcccacattttccagtcttcttctgagccctccaaactcttccaacctctgcctgttaccaagtttcaaagtcgcttgcacattttttggatgtcttttcagcagcatcccactccactggtaccaatttactgtattagtctgttttcacactgctgaaaaagacatacccaagtctgagaagaaaaagaggtgtaaagaaaaagaactgtaattggatttacagtcccacatggtggaggaggcctcagagtcatggtaggaggtgaaaggcacttcttacatggcagcagcaagagaaaatgaggaggaagccaaagcagaaacccctgataaacccatcagatctcatgaggcttattcactatcacgagactagcacaggaaagactggcctccgtgattcaattacctcaccctgggtccctcccataacatgtgggaattctggagatagaattcaagctgagatttgggtgtggacacagccaaaccatatcaccaaatatggagagactgtggatcaacaagatcatctcaaactaatacaggaggtgagagtttaaattagaacaaccactttggaaagaaatttggattatcttataaatttgagcattctcatatgttatggcaaagtaattcctctaccataggccctggagaaactcttgcccatatgcaccagaagtagtaaaaaaataaatgctcatgtaatgccattcataatagcaaaaatctagaaataagccaaatgttcattaataggagaatgggtaaactgatagaagaatgggtaaataaattatacccttaaaaactaaataatatgtcatttaaggcaatcatatgtatgcaataaaacaatgtttttttaaaggaagggaatcctaaacataaattcagggtagtagttaccctcgggctgaagggtgaaaatcaggaaaaaggacagaggaggagcagatgttagggtcagaaccctagttcttgggttcataagtgattaccatattgttcaaatacatttactcagaggcccaggcacagacaaggatgaaataggagccaaggtatgctatgagccaaggattatgattaatccaattttgtgcactttaagccatttgaaaaacagaaaagcaaaacaacaaaataatttttaagaaattgaatatagggtgttttgctctgaatgtgtccccctaaaattaatcaccaatgtcataggattaggaagtagagcttttaggtagtgattccttcatgaagggagagtcttcacgaatgagtttaggatccttacacaaggattggagggagtgggcttcccctgttttgcccttctgccttctgccatgtgaggacacagtgcatctcctcctgaagacacagtgcagaagataccatcttggatgtagagaccaggccctcaccagacaccaatcctgctggcaccttgatcttggacttctagcttatggaactgtgagaaatacatttctgttcttcagaaattacccagcctagtgtattttttatatagtagcagaaactcattaaggcataatgcctcttgtcattttcttctacaattttctttgctgcctctttagcactggggcattttatatttgatccttcatcatatctcttacttttggtttttcacatttctgttccaagtgtattcttagacacatattttccaatatttgttagcatccaggtcagaaagtccagaataccttcttttaaggcttccgtttctgcaacaatgaagtattaacgcctcctgtaaactaggtatttcctttccaattgtaactgccatctggaggcaaagtagaattctagtctatgagtgtggggttgatttttaatgtatctagagtatggtaaaatgctggtttttaatcacacagatacattgattgcttggcacactagggtaccagttgctagttatctctgtattgatccatgctgttacagagggaaagtacagaccatgaagttggaccagctgtcatacccacaacatttggggagctttgattttttttaacctttagctgcttaactgtcacatctagaagctcaggtgaaaagcacccttattgtggggactttcccttagtgctctgtggcactaaagagcagacctatgtagaagcatttaagtattttgtgcatcaacaggaaaattaaaggaacaaattcttattgtatcctttagtccctgacgacaaaaccacagtgacagtaactaggtcatggcattgtattcagagagggtcagccttggtatttgacagtgagtcccctgtaccccactgtcaagactcactgagcagacgggaaagttcaggtggaacatgcagtaaagagcaaacacggtggggggcgctcactgtcatacactgccatgcctgccatggtcagcagacctgtcttctatttgacaacaggcaagttgagaaacatttttttggagagtttcttgattcttcccagttgtggcaggatggactgacttagaggagctcaggaaggttgttaaacaacacagaaacgcaacatgaattgtactcctcagcaggcctatgttagagcagcaggtccttgaagcctcagccactcctgggacacagcataatgcccctaatgatttcaaatttggtggagagtgggctgctaatcccagtgtccagggacaaaaagagacataaacagcaaaaagttataaaataagtgggcctaacatctgcttattgtgggaggtagggatttaaggtataagaatttagctgcatgtggaagctcacacctgtaatctcagcacttgaggaggtcaacgcaggaggacagcttgagcccaggagtttgacaagagccaggaaacatactaagtccgcattcgttcaaaaatgttttgaagaaaagtagttgagtgtggggacacatgcctgtagtcctaggtacgtgggagcctgagacaagaaaattgcttaagcttgggagattgacactgcaatgagctgtgatcacaacaatgcacgccagcctgtgagtccggagacccgaaccagcacccttaagcagggtccacctccacctgtagaaatcggcccaaggaggtcctgaggaaaggactcccgggagtccggctctggggggcccgaagccccactcccacaacgccccctactacatcccagctcaagcaaacaccgtgactgccacaaaaacccccgaccacacatcgcaaaacctgtttaaaggagccacagccggactttgaagagcaaagcccgactccgcatgggaaatgcaaatgcgcgaggcgccagcccattctccagtcacagtgactccaacagttggctgaggaccactccttaaaccttatcaaagcaagagcactttcggacagtgcgtcggcgttgaggatctagcatgaccaacccagggggtcgaaaaaacagtttcaggacaccacgatacactgagggctaaccaggaagcagaaagaacagacggagtcctgtgaaagaagcgcaacatcccagactcaggcctgcccggacggtgttcgggtgagtctccccagaagtcgtgcccccgagatctcgaggacaggactgccagcgtgcccgggggctattcgctcacacaagtttcgttcccgacgagagcagaacccggcagccacaggggttgcctgggggccagtatttctatgccacccctgtaggactgtgggtgggggtgtccaccgtgactggatgtgtcttctaggaaacgacagtcttgaagaggaagccgggaatgggagatggcaacaatccccgtccctggaacgccggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacagcaggccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgagccgcgcgccgctttttgcttcacagtgcttcccacggttgtcttaggaaccagtccccgaggcttggcaacacaggagccctccgtggcagcgcttgggtgtcgggcctccgaggctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccacaggggttgcctgggggcgtgcattgctcggccaccgcggtaggactgtgtgtggggctgtgtctcccattctcccttctctctctgtctctcaccctctgtgtgcttctttccctctgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttccactttgggtctgtgcaggcctcgataacgtgaggggatgcatcgggcccggagcagtggaagtctcatccccatcctgagcggcctcttttctaggatcgagaggaccacactgcagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccgtccctggaacgctggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacaccagccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgaggcgcgcgccgctttttgcttcacagtgcttcccacggttgtcttaggaaccagtccccgaggcttggcaacgcgggagccctccgtggcagcgcctgggtgtcgggcctccgaggctccggcctgacctctccacggggtccacaggaacgtctccggctgccaggagtcgcaaggggccgagcaggatgaggaaaccacaggcggagtccaggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccgcaggggttgcctgggggcgtgtatttctcggccaccgcggtaggactgtgtgtggggctgtgtctcccattctcccttctctctctgtctctcaccctctgtgtgcttctttccctctgtgtgtgtgtgtgtgtgtgtgtgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttgcactttgggtctgtgcaggcctcgataacgtgaggggatgcatcgggcccggagcaatggaagtctcatccccatcctgagcggcctcttttctaggatcgagaggaccacactccagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccatccctggaacgctggccactctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttcgccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacagagggactgcgctgggactggggctggggctgcgtgcagtggaggttgtgtcagggctagctgggtggtggatggttgggggtggggtgactgttgcagaaacccctgttgtcctctggcaggcatttcaaaatgtggcttggactgaggcacaggccccgtccatgttcccaggtcttctttgagttcccttggcactcagggaaaggccagttgatccccctttccaccgggcacattcctggacagcaatgttggtttctcccttgccccatatgcctccggtgacatacattcacgccatctgctctggtatatgccagtgccaggcgtgaccgcattgtcaccacctggcattcgccccgtccctgtctgcacgtgtcctggaaagcggtatcggcttgcaggagccccagggctttcagaagcgggccagttcactgctgtttcaaaggaggagggaggcagagggctcacgattcagtgaattttccactgacagcaggccttgagggccatgggatcattctctgctgcagccaggccctgcctgcctcagcaaatgtggtgagcccctcctttctcacccggagtggtccaaaatggcatctgaagaggagtcctgagaacccagcaggcgccctgaagctccccgtccatcggcggaagttggctcaaggaggtcctgaatacgggattcctgggggctttgcccggggacacccgcggccccttgtcacaggcgccccgaaactgtaccccggatccagccgcagccgcggctgcgcaggcgcgccccctgccgccccgcacctgcggttatttaaagctgacacagcttgcctgagggccaggagcccatgcgagtcgacccagccaatgcgcatgctcgagtggctcgccgcttttcgcgtcatagtggttctcacggttgtcttaggaaccagtcccttggcaacgcgggacccctccgtggcagcgcttgggtgtcgggcctccgaggcttcggcctgacctctccacggggtccacaggaacgtctctggctgccaggagtcgcaaggggctgagcaggatgaggaaaccacaggcggagtccggtggaagcagcgtggcatcccagcctcaggcctgccaggacggtgttcgggtgagtctcccgagaagtcgtgcccccgtgatctcgaggacaggtccgcctgcgtgcccgagggctgttctgtcatcggagggtcgttcccgtcaggagcagaacccggcagccgcaggggttgcctgggggcatgtatttctcggccaccgcggtaggactgtgtgtgggggtgtgtctcccattctcccttctctctctgtctctcaccctctgtgtgcttcttttcctctgtgtgtgtgtgtgtgtgtgtgccagtgtgcgtgtgtgtctttgaacgaatgtgccttgtgcgtcagaaagggatttcttgcttgtctgccggtctttggtgggtttctttctgcgtctctccctgggtcctgtccagctgtccatcgttttcacggcggttccactttgggtttgcgaaatcctcgatcacgtgaggggatgcgtcggccgggagcaatggaagtctcatccccatcatgagcgtcctcttttctaggatcaagaggaccacactccagcccaggacaaatgccccacggtagcacattgtccggcaggagaggagcagacccacgtccaagaagatggttgtacctttccacgcctcttctctgcgaaatgaagccacagaacgacacaatcttgaagaggaagccgtgaatgggagactgcaacaatctgtgtccctggaatgctggcctctctggacaagccacgcacttcgcacccctcctgttatgcccgtggcggtggcacggcgctgtatcctacctgggctctggcctcctctctgtcctccctcttgctctgtctcccctgtttctgagcggcctaggtgcctcttggcctggctgaatatcttctacaaagatcacttcccagtccatcagggactctcttcctggaaatcggtgtcatgactgtttctctctccaaacctgtttctgctgggttggttaggtctggtgaccctggagctcttgtcttccatacgtgtctcagccagggaagcttcctcggtctccatgtttcacctcatttgtgggtggattttctagaattagttgtaggcgacagtgactggtcttgtcttctaggacaggagaggtgccgcatttcttctgcacttcctgtctcatcctttagggacatgctgtcctctgctcctgggtgtactgagtccctgaatcttttggccccctcctgcatcccaggtgttctttgattttccttcgcattgatggaaaggtcacttgtgccccgcttccgccggccacatgcctggacaccattttttgtttcgccatcgccccatacgccctcggtgacacacatttatgccatctgctctgcggtacaccatgccacgtatggtctcattggctccacctcggaatttcccctgtccctgtgttcacgtgtcctggaaagtggtatcagctttcaagtgcaccagggcttttcttttttcaaaggagaagggaggcatcagtgaattttcagctgacacctcgccttggggcccatgggatcattctgggatgcagcgaggccctgccttcctagcagatgtggtgagcccatcctttctcacccggaggggtccaaagtcggatctcaagaggagttctgggaccccagcaggcgcccagaagctccacctccaccccggaagtcggcttaaggaggtcctcaagaccggactcctgggggtttggccttgggacgcctgtggcctcctctcccacgctgccccgtactggacccctgatccagccaccgccagggctgcaatgcgagccgcccttcctctgcgtagccgctattgtttaaaggggtcgcagcctgactgccaggagcggagtgcgactcggcccctccaatgcgcatgcgcaaggccctggcgcatgctccagtcacagttattcccacggttgtcttagaaacccgtccctgaggcttggcaaagtaggagccctccgtggcagtgcttgggtgtcggggctccgaggctccggcctgacctctccacggggtcgacaggaacatctctggctgccaggagtcgcaaagggccgaccaggatgacgaaaccacaggcgaagtccgggggaagcggcatggcatgccagcctcaggcctgccaggacggtgttcgggtgagtctccccagaagtcgtgcccccgtgatctcaaggaccggtctgcttgcatgcctatgggctgctctctcacctgagggtcgttctcatgtggagcagaaccctgctgcctcagaggttgccttggggtgtggtgtgtttctgtgccagtgctgtatgactgtgtgtttttgtttctgtgtgtgtgtgtgtgtgtgtgtgtctcctattctctcctctctctctgtctcttactctttccctctctctgtcggtttgtttgtgtccttgtgcgtgtgtttgtttggacgaatgtgccttgtgcgccaaagaagctatttttgcatgtcgtctggtctttgttgagcctctttctgggtctctgcctgggtcatgtggccggctgtctatcgttttctcggcgtttccactttgggttcgtggagacctcgaccacgtgaggagatgcgtcagtcccggggcaattgaaatctcatccccatcctgagcagcctcttttctaggatcaatatgaccacactccagccaaggacaaaatgctcacaggaggtcatttttctgcaggggtggagccaaccaaagtcaaagaagattgttgtatcttttcacagctcttctctgagaacgaagccacacaacgatagaatcttgaagaagaagctaggaatgggagatggcaacaatccctgtcactggaacactggtctctctggacaagtcaccagtttggcacccctccccttatgcctgtaccgatggcatggtgctatatcctgcctgggctctggcctctgctctgtcctccctcttgctctgtctcccctgtttctgaggggccttgatgtttcttgatctgtctgaatgtcttcaacaaagaccacttcccagtcctccagggcgacacttcctggagatccgtgtcatgattgtttctccctccaaacctgtttctgcttgattagccagggttgatgatcctggggctcttggcttccatacgtatctcagacagggaagctagcttggtctccatgtttcacctcatgggtgagtggattgcctagaatgagcagtaggtgactgtgactggccttgtcttctagggcagggacatgtcgcatttcctctgcacttcctgtctcattcttgagaaacatcctcccctctgctcatgggtggactgactccttgaatcttttggctgtaatgaaagtcagggatccaatgggactgggctggggctggagctggatgcaggggaggttctgtcagggctacctgggcattggaggattgggggtggattgaactttgcataaacctctttactcctccagcaggcttttcaaaatgtggcttggactcatgcaataagaaatttaccggttgaaagggcccctttttcaatggcactctgggtaacatcgcttcagcacaatcatatggtagagaagccttatcaaatttgctgtccctcagggctcttaaagatgcttgataaattattagggaaataagaaacaaattgaaaggaaaaggaaatccaaggacctgccccagaagaatcatagatatgtttgaatacttattcattatttgccccagatagaaaatgtttgttaatcaaaaggcaaaagttataatgaggaagataatattgcctggggcaatgttgagacaaataaggtgaagatcaaccaaacgccctgagtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaatgtttttattttgagttatttatagtttagaaaaattgggtgaagtgtgtttttgtgagcaaatttatttttctctaggttatccgtaatttgaaagctgtgagtattctgattaggtgacaatatagttatttgcttaagtacatcttttattgtaaaatgggacaaatggagacactggttattttacccaggctttgactagaataacttaattttaggtaaatcccaacaaacccaacttaagaggagtctatatgaccaattaattgtttctgcactttaagcaaatactcaggctgtactagtcccttctcacactgctataaagatattacctgagactgggtaatttataaacaagagaggtttaactgacagttctgcatagccggggaggcctcagaaaacttacagttatgatagaaaggaaagtaggcaccttcttcaaaaggtggcaggagagactgtgtgtgtgtgtgtgtaaaggataaaatgtcaaacacttatacaatcatcagatttcataactcactatcatgaaaacagcatgggtgaaacaactcccatgatacaatcacctcccaccaggagggatgacaatttgaaatgagatttgggtgagcacacagagtcaagccatatcacaagccaaccataataagcctaaaacttatttttcacacaaattgttctcactatgacttctcctacagattgtttcaagggaaaagggtaatgcttgttactaaatgtcagctctggcttttattttattgagtacaaattgaatcataaaatttttttattttattttattttcctttaagttccagaatacatgtgcagaatgtgcaggtttgttaagtaggtatacacgtgccatggtagtttgctatacctattgacccatcctttaagttccctcccctcacccctcaccccccaacaggccctggtgtgtgcttttctgctccctgtgtccatgtgttctcattgttcaacttccacttatgagtgagaacatgtggtgtttggttttctgttcctgttttagtttgctaaggatgatggcttccagcttcatcaatgtccatgcaaagggcatgatctcattccttttatggctgcatagtattccatgatgtatatgtactacattttgtttatccagtctatccttgatgggcatttggactagttccatgactttgctattgtaaatagtgctgcaataaacatatgtgtgcatgtgtctttagagtagaataatttatattattttgggtatatatccagtaatggggctgctgggtcaaatggtatttctggttttagatccttgaggaatcgtcatactgtcttccacaatggttgaactaatttacatgcccaccaacagtgtaaaagcattcctatttctccacagcctggtcagcttctactgtttcttgattttttaataactgccatccgactggtgttagatggtatctcattgtagttttgatttgcatttctcaaataatcagtgatgttgagctttttttatatatttgttggccatgtaaatatcttctttggagaagtgtctgttcatgttctttgctcattttttgattgggttatttgtttttttcttgtgaatttgtttaatttccttgtcaattctggctattagacctttgtcagatgggtagattgcaaaatttttctcccattctgttgtttgcctattcactctgatgatagtttcttttgctgtgcagaagctctttagtttacttagatctcatttgtcaatcttggcttctgttgcagttgcttttggcatttttgtcatgaagtctttgctcatgcctatgtcctgaatggtattgcccaggttttcttctagtgtttttatggtttggggcttgacatttaagtcttatgtttaaggtttaaagtcttaagtttaaggtttaaggaagggttccagtttcagttttctgcatatggccagtgaattttcccagccctatttatcgaataggagattctttcttcattgcttctttttgtcaggtttgttgaagatcatatggatgtagatgtgtggtgttatttctgaggtctttgttctgtttcattagtgtatatgtctgttttggtacaagtaccatgctgtgttggttagtgtagccttgtagtatagtttgaagtagtgtgatgcctccaactttgttctttttgctattccaaacaattgaaaaggagtgacttccccctaactcattttatgaagccagcatcatcatgatagcagaatcaggaagacacacacacacacacacacacacacacacacacacttcaggccaatatccctgatgaacatcgatgcacaaatcctcaataaaatactagcaaaccgaattcagcggcatatcaaaacacttatctaccacaatcaagtcagcttcatccctgggatgcaagactgttccaccatgcacaaataaataaacataatccatcaacataaacagaaccaaagacaaaaaccacgtgattatctcaataggtgcagaaaaggcctttgataaaattccacaccacttcatgttaaaaactctcaataaactaggtattgatggaacatatctcaaaataataagagctatttatgacaaccctacagccaatatcacagtcaatgggcaaaagctgtaagcattgcctttgaaaactggtacaagacaaggaagccctctctcaccacttctattcaacatagtattggaagttctggcaagggcaatcaggcaagaggaagaaataaagggtattcatataggaagagaggaagtcaagttgcctctgattgcagatgatatgctgctatatttagaaaactccataatctcagccccaaaaccccttaaactgataagcaacttcagcaaagtctcatgatataaaatcaatgtccaaaaatcacaagcattcctttacaccaacaatagacaagtagagagacaaataatgaatgaactcccattcacaattgctaaaaaaatgaataaaatacctagaaatacagctaacaagggatgtgaaagacctcttcaaggagaactacaaaccactgctcaaggaaataagaggacatacacaaatggaaaaagattccatccccatggataggaaaaatcaatactataaaaatagccatattgcccaaagtaatttatagattcagtgctattcccatcaaactaccactgacattcttcacaaaattagaaaaatctactttaaatttcatacagaaccaaagaagaccccgtatagccaagatgatcctgagaatcctgaaagttttcatagttataataatcttctaatgagtacaggattatcatttttcttcatattttcagttggtgacctaatgaaatagcgtattttttctcttttgacacacaagtactcttctgatggtcaaaatagtaagttatttatctctccttgtttcacttcaaaggaaaccagaatcatggcattctgaaagttagagatgcaaatctccattatttggcatcccactggacccgatctgtttttcattgcaaatgtcctgctgctaagactatgcaaggaccctccctctaggcccagagactgttgcagaggagatgggtgcatgagattgtaagggctggttatgagggatacagttagctcagacactccaaatcaaggagggtacacaggtgcctaaacagcttgtaaaacaaagaactttgctttctcagctattatgtggcacctttttatccaccccaaccatgaaaaatgtcctgcttcctggaattaaaacaaaataattattaagaggataaagatacctcatgaccaagcctcctgggcataatactcccagttataagttttgcagatatatatatatttagatatataaaattattttttagaaaaatgtatatgttttgtatagttaatcactgtaagtctgtaatgaaaaccaagattatagtagctcaatgcatagaagtgaaagaaaagtcaatttttgtaaactcgccattggctttttgtttttggctctttactttaaatatatcttttaaggggtaatgaatgcctgtccgagtccattcctgtctttcctagaacgcttacttgtctataagtatttgacttcaagtccctccaccatagagagtctcactgaagggcaggatggacacagggcaggcagatatgccacccaagcagtgctaggggaaaaaaaataatagccattgatgctgatgctggcaaatattggccataaatggaagaatgtaagccaaaaataaaattctaagcccttcaaccatctgaatgtacccctcctctcggccataggaattccagattgaaactgaaaatcttgttcaggccatgatggaagagagcattggacatgcctcattatatttctctagcattaacatcaacacagaccttaagacatcaacatcagacctaagagtctgatcagaaatatttaacatctattttctctgaagcctgctacctggaggctttatctgcctgataatatctaggtttctccaactccttatcttaacccagacattcctttctactgataataactctttcaaccaattgccaatcagaaaattttaaaatctacctataacctggaagtccccacttcgagttgtcctgcacttccagactgaaacaatatataccttacatgtattgactgatgtctcatgtctccctaaaatgtgtaaaactaggctgtgccctgaccatcttgtgcacatgttctcagggtctcctgagggctgtgtcatggcccattggtcacttatatttggctcagaataaatctcttcaaatattttagagtttgactctttttgttgaccagtcactccctagtaagtttaggagcagggatctgacagcaaccatatcatgctcagaaacagcattctctcatccactgtccccaggctctgcagaacccagggtcctggtatccataacccaaggaaatgggaaggagtcatgagctcttgggctttctcattctctgaaaatggacaattgataactagccgtgattttgtttagaagtataaataaatgtcacatttctaagcaaaatcaagtctagtttcaaatgtgtgaaaggaaaatagaaacttgggaccccaattcactctgccaaaaggagaaagttaagctgaaagctgagtcatgtgagaagctgactttccttttgctcttaagcacacagctccagatagaaggtaaaatattcccacaggtaggtgctctgtcctcatcttaccttatgtgaagtgctgatttactgagcataagatgaataccaaattgactattcccctgccttatccttttcttttgcaatgtgtggattcagtaatgtgaccatacccttcctctttcccctccagcaaactcttcccctttaagtattgaagcctcagcatcatttttggaaaaaggcacagaccacagattgtttctattattctgtgttttttccttccaacttgtccttaatcttggcaaaataaacttctaaattgattgatacctgtctcagatacttactcgtttatgaatattagaagcagtttgtgttctcgtcgtatgtgttattacagctatccctttttatccaaccttttactatcaagctcaataatctaataaaatcagataactttttaggtgagtccctttctatataaactcttgctattcatactggagctacattcatttggatagtgctctccctcctgagtcaagcttggtgcctgactctccctatccaaatcagaagccaaatagacttggaaggttcaggcagtcagtgtacacagaacacacacgaccttttcgtttagccatcgctagttatctctagtaggtgtaataaggagaaatgtttacttttcaaatacattgctgtggtgttttaatttttacaagcatgtttacataactaatttttataaaatacacctgttgctggatacctcttgttcctatcttgataaccatcaccgagatttgcaaaggaggccttgctcaaatatttggaaactaatgccctcagggagatgtccaccagccttgttcctctcattcctatttaaagattgtaatgtcattgggtctttccctagggtggcccctggttttccaggctggacactcctgtgttgaagatgcatcgactcacgtactgcattaatgttttagattttactgtgaagcaaacaattcactcctcagaccctcagtcacccaagtccacatctggacttgaggtttggcttctctggtcctaactgggacttatctgaccctgacaggagataacttcagtagggactttccctaatagcaaacatgcacacttcaacttggcttgccctgaaggtaacatttactcattataatggtaaaaaaaaaacacacccctgggtggagatttcagacattactaagacgtgtgatatatgtactagcgtgtatgaccatacagcatgtgcacccaggagaccacccaaaacatgtttgctagtaacaccccttcacaacccctttcatgaataatcatataagaccctcataagggagcttccccagtgccgatcaacgctgtttctttttccaagcagcccgctctgacttggcttttagagggtactctctctttaaataaactctgcagctgcttcactgtcactgattacttcttggctgaattctttccttcaagaagacaagaactgaagaccccacaccttccggtaacattaccaactctttctcctttttctctggagctggtgctcagatggtgagagccctgagctaatagtcccagggtgggagcctgtttgcccctgtctggtcctcagcaatgtccttggtcagcttcctggcaagagctgtcgattaccagagggaacaagtgatcagcaccagagtcgatcacttcacagaggagctgaagtggacagggtcagctcaggcctcacggactagggcgggaatgtcccgtgacggcaggtcagtgtcttagcttcctttgaggcacctcttcatagactgcagggatcatttaggtaagaatatagcctgctgacttttacaccttgctgaaaatctttgctaatagcaatctgttagctgtgaaaattaccattgttttttatttttcgttttgttccttattactgaagatattctatggagcgttaaagcctcctgcggtaagaaactagtaaagaaacatactgtttgcaggaaggaaaattacccacaattcttgttctctaaggtgcgtggttatcattccaacagccattctcagcaatgaactgaagaccctcagatgtgtttcattcccttagtattttaatcctctcctccactctcaattgccacttctcccgtgaatgaggggagaggggttgggagggacatctcctgtcttgggcccacagattttaaagttcaagtcagaagctccagtgatttcctgtatgtagtagtcaggggcaagacagatctgtggttggtagtctttccttctctgtacatctgccagcctctctcctcaagctggggcttcatggagtcccagaactttgaacctgaagtagtgtcagcagccatgttgcagctggagtcaggccaattgttggtcttgctccctcgtgactgggacacttggaagagccaaatgggcaggcttggagagcgtgtacttttggaactgaagtgtatcttaaaccatttcattgcaactacgtgtgtgtgttgggaggatgcataacagcctcactgaggggtgactgacatataatagaaggacttgtgcacccgtgaaaccatcactgttatcaagacagcgagcatgtccatcccccataggttttcttgtgctcctttgtgatcccttcctcctgcctctcctgccatgctccaccccaagcaaccactgatctgctttctgtcacaatatatagattggaaaactacttataataccagttctaacctcatcaagcaaatactttctttttgtcagttgaacttttcattgtgtgttcaacattcttgattcagaaagagtgagagagaaaggctggtgtgggcccttcctgggaggcctggccctatccacagctccagtgtggctcacgtgccctggagcccctgcccacaggacagtcctgactgctcatccacaagctttgtggtatcctctaccattcctaggcaggctctgtacagtgcagaactttctcccagtccttgcaccaaaataacaaatgtcagagatagtacatttggagccagtggctgtgcctcacctctagatgcctgtaatactgagctgctaagcaagaggtccctcccttcttgcccttttcttggggcctcatcccttgtgctctgctcttcctcacacaggatatatcttctgattgctcctctcccacctcctgcagtccctggacccccatggcaatacaaacagactcttctatatcctcagtccattgcaggaccacagctctgacctggctgtcctctgttttccaagccctgcacctgtggagttgggaattagcacccacttgaccccattgtggcatcaggcccaccctccccaatgcaggaagagttccagatgttggggagctatggcattatcctgcacacatatcatgtcctggcctgggaaagtgatgatgatgatattttcccacaaaatagacaataacatcatgaaagtgccttgttcattttctagcataaaatatatatcaaagcagtggggtttagtaggcatacgtagatttaaaagctcctcagaaggcagggaatgatttcttcaacagaaaaaaaaactaccccaaaaggagaatctcaatactttggttgatagtaaattaagaatccctcaagaaattcagtaggagagggaaaagataagtcaccaatgggaaatatatttgtcacaatataacaggcaaaggactcatgtccagagtgcatgaaggatttctacaaataaaataaagaatccaacagaaaaatgaagaagagaaaggaataggaacttcatttttaaaaaagagaaaagaaaaaggaagtaaggaaaaacaaatgaacatccaaatggccagaaagcatataaaaatgcccaacctcataaaccatcagacaaatgtgatccacaatgagaagccaatacacaccgaccagcacggctaaaattaagaagactgttaataccaagtgttggtgagaatgtgaagtaactgaaacatttatacactgctggtggaaatgtgaaatagcacaactactttggaaaattatttgggaatactgctaaaggtgagcacccctatgatcctgaaatcccactccaatatgaaaacccaaaagaaatgcatcctgatagaggcactcttcatagtagcccaatgttaatcatggaagaatggacaagtatatatcatatcatggaatttttatggtaatgaaaatagattaataactgccatgcacagttggtgaatcccaccaacataatgttgagtgaaagaaacctgatacaaatgaatgtatactacactatttcatttctgtgaagctccaaaataagcaaaacgaacctatagtgttataagtcagtagagtgattatcttagtatttgcatgggagctctggtaatgttttatttcttgatctaagggctggtgtcccagatgtgttcactttgtgataattcatcaatctgttttcttgggagctgtggcttatctgtgcagatatactccaattaaaaaaatcattcaactcaatgacaacaacaacaaaaaaaactcgattttttaacattttgtggagtgtttattatgatccagtcagcgtactaaatacactattttatttgatccttaaaataacttaaacaacttgatttaaatatgggcaaaggacttgagaagacatttctccaaagaagatatacaaaaagcacatggaaaacccttgacataattagtaatctgggaatgcaaatgtaaaccacggtgggataccacttcacacatgttagaatgactattatccaaaaataaaacaaacagaaaataacaagcattggcaaggatgtggagaaattgaaacccccatgcattgttggtgggaatgtaaaatggtgcagccgctgtggaaaacagtttgatggctcctcagaaaaccatacacagaattaacatatgatccagcattgccactttcaggtatatacccaaaacaatagcatgaaacacataaagagacatgttcatagcagtattattcagaataactaaaaggtggaagccatgttaagtgttcattgacagatgaatggataagcaaaatgtggtatatccatacaatgaaatattattcagcttttaaaaggaaggaaatttgatacatgcaacaacatggatgaatcttcaggacattgcgttcagtgaaataaaccagtcacaaaaagacaaatactacaagattgcaattacatggatacctagaacagtcaaattcatacagacagaaagtagaatggtggttgccatgtcccaaagccaacataaagcagcagttgtggacagcttcagtttcagctgaacttgactgtatgttgtgctgaaaccagggtaatctgatgtccaacactcagagccagttaagacttttgtttctggtgacctggggagctgacagtgcttttcaggcacacctggggtaactcttatttcccaaatgggttggcagattgttgtgggtgccaggtctttgatggactggatctagacacgaataaatagcctgctgggattttgattcggattgtagtcaatctatattgaatctgtgttttaagagtataacctcttaacaatattgagtcttctcactcatgaacaacatatatctccccatttatttatggcttctttaatttatcatagcaatgttttacagttttctgtgtacaggccttttacattttttgtcagatttgttcctaagtactttacattttgcatgctattgtaaatgttgttaatttttttattttaatttcttcattttttacttgacaaatacaaattttatctattcatagtgtacaatatgatattttgcaatatgtatacattttgggatggttaatccaaccaataatatatgcattacattttaattttcaattaagttacaaagctctcattaaacaatttttgtacactaatttgtcctgaaaccttgataaacacacttattaacttcttgtacattccactgaattttctacacagacagtcatgtcgtctgtgaataatgaccatttatgtctttctttccaaactgaatgtcctttatttctgtttcttggctgattgcacagtctacagcctccaatacagtgctggatagaggtggtgagggcaggcatccctagtgtgttcctgatgtgaaggggaaagtattcagtcttccacaatcaagtgtgatgctagctgaaggacttttggaattgccctttatcagcttgaggaagttccctctgttcctaatttgcctcagtttttatcaataatggatgttggattttgcaaaatgttttttctgtattgattatggtgatcatataattttttagtttgtttatgtggtaaattacattgatttatttttttactcttaaatcaaccttgcatttctaggataaataccacttaattatgatgtattacatttctattatatttaggattccatttgctaaacttttgcatagaattcttgccctatgttcatgaggattattggtctgtagttttgttttcttctaatatccttgtctggccagggtatcagggtaatgctgatttcatagattgagttgggaagtatttcctcctcttcagtttttggaagagtttgtgaagtcttgttattacttctcccttaaatgtttggtaaaattcactactatcaccatctgggcctgaatttctttatagggaggtttttatgttattctttttttttttttttgagacagtctccctctgtcacccaggctggagtgcagtggtgtgatctcagctcactgcagcctccacctcctgggttcaagtgattctcttgcctcagcctcccaagtagctggtattccaggctcatgccaccacgcctggctactttttgtatatttggtagacaagaggtttcactgtgttagccaggatggtctccatctcctgacctcatcctgacctcatgatccgcccacctcagcctcccaaattgctgggattacagggatgagccacggagccaggatttttttttttttttgagggagagtctcgctctgttgcccaggctggagtgcagaggtgtgacctcagctcactgcaacctcgggggaacccacccctgataattcaatgtgggtacttttctattttccctaagtgtcagccagtctgagaaataaagggaaagagtacaaaagagagaaattttaaagctgggtttccaagggagacatcacatgtcggcaggttccatgaggccccacaagccgcaaaagcagccagtttttattagtggttttcaaatggggagggagtgtatgaacagggtgtgggtcacagagatcacatgcttcacaaggtaataaaatatcacaaggcaaatggaggcagagtgagatcacaggactggggtgaaattaaaattgttaatgaagtttcgggcacgcattgtcattgataacatcttatcaggagacagggtttgagagcagataaccaggtctgaccaaaatttattaggcgggaatttcctcatcctaataagcctgggagtgctacaggagaccggggcttatttcatcccttatcgacgatcataaaaggcagatgttcacagagcggccatctcagagacctccccctaggaacacactctctttctcagggctgttcttcgctgagaaaaagaattcagtgatatttctcctctttgcttttgaaagaagagaaacatggctctgttccgcctggctctcaggcagccagacctaatggatatctcccttgttccctgaacatcgctgttatcctgttcttttttcaaggtgcccagatttcatattgtttaaacaatttgtgcagttaatgcaatcatcacagggtcatgaggcgacatacatcctcagtttatgaagatgacaggattaggagattaaagtaaagacgggcataggaaatcacaagagtattgattggggaagtgataaatgtccatgaaatcacaatttatgttcagagattgcagtaaagacagacataagaaattataaaagtattaatttggggaactaatacatgtccatgaaatcttcacaatttatgttcttctgccatggcttcagccagtccctccattcagggtccctgacttcctgcaacaccccccatcccaggttcaagcaattttcctgcctcaacctcccaagtctttggggttacaggtgcctgccaccatacctagctaatttttgtatttttagtagagatgaggtttcactatgttggccaagctggtctcgaactcctgacctcaggtgatctgtctgcatcaacctcccaaggtgctggtgctgggattaaaggcataagccactgtgcctagcctatagggaggttttaaaacaacacttttcatcatttctaggccttttacctaagatcaagtgtaaaaaatgaatttgagtttctttaatagatacaggggttttcaagttatccatttcttcttgggtgaactttggtaatttgtctttgaactaatttgtcaattttatccatggtgttgaatttaattggcataaaagtattcctagtattattttactatccctttatatctgtagaatctttagtgatgtcacctctctcataccttctactggtaattctctcttttttccctgatcaatctggctgaaaatgtatcaatgtcattgattttcccaaagaacaagacttgggattcattgattttcctctaacctattttctttcactgattcccactttgatctttattattccatttttctgcttactttggatttaatttgcttttttttcccatctttaagtgaaaactgaagtcactgatttgagtcctctcttcttttctaatataatatttaatgacataaattttcctctaggtactgttttagtgacagcccatatattctatgttgttttctattttcattcactttgaattgctttctaatttccctttagatttctcctttgacctatgggttatttagaagtgtattagatgtcagatatttggggattttcaaggatctttctgtcactgatttctaatttaattctaattcgtcatatgcagtatgttccacagagaacacactgtgtatgatgaatgcttttgaatttattgagacttttaaaaatcagccacaatgtggtctagattcataaatgttccatgtgcacttgggaaaaatctgtattctgctattgtagagcgaagtgttctgcaaatatcaatcaagtcaagttagctgatagtgttgttcaaatctactatattcttttttgtttgtttgtttgtttgtttgtttttgagatggagtctcattctgtagcccagtttagagtgcagcagcacaatctcggctcactgcaacctctgcctcctgggttcaagtaattctccctgcctcagcctcccaagtagctgggattacaagcgcttgccacatgtccagctaatttttgtatttttagtagagatggggttttgccatgttggccagactggtctcgaactcctgacctcaggtaatctgcccacttcggcctcccaaagtactgggattacaggcatgagccactgcacccagcaaaatctactgcattcttactgattttctgcccacttgttctattaattattgagagagagctattaaaatatctgatagttatgcatttttctatttctctttgatgttttattagtttttcttttattcattttgaaggcttattaggtacaaaaacatgaaggattgttatatcttcttcgctgaccacatcgtcagtatgaaataacctttaattcctagaaataattctttgctctgaaatctattttgatattaatatagccactctaaatttcttttgactagttttagcatggtatatctttttccatctttatacttttaacctatttgtgtctttatatttatagtgcctttcttataggcagaatatagttgggtctttgtttttcaatgtaatttgacactctctgccttttagttggggtatttagactatttacctttaatatgattactgatatgattaggttgagccactcaccttgcatatgttctctattcatctcatctgttttttatttcctttttccattttcctttgaattaatcaagtatttttatcataccattttatctcattttatctctcttgttaaacagccacatttctttttttttttttgagatggattctcactctgtcacctaggccagagtgcagtggcatgatctcggctcactgcaagctctgcttcctgggttcacaccattctcctgccttagcctcccaagtagctgagactacaggtgcccgccaccacacctggctaattttttgtatttttagtagagacggagtttcaccgtattagccaggatggtctcgatctcctgacctcatgatccatcctcctcggcctcccaaagtgctgggattacaggcgtgagccactgcacccagcctacaattcttttttgttttaattgtaaaccttaagataatacattttatttgaagtaaggtgctgaagaggtgttatttgtgtagggtgttaaaataatggtaagctatgagaaggggaaaagggcactgaggctaaggagttagtttaaaaaaaaacagaccagtacacatgggaatgtttgtgtagttttgtactggggtggttagatttggcagtcgctgaagctatgtatgtaggcaaagactgaatgagagatgaatctggaatggcaatttcaaattagtcactagaagacctcaaaccatcccctctacaaccccagttctgtagatattgaaagaatggtggacccggggcccactctctctgaacttgactcctcacttccctatgaaagctggctttgctatgtgccctgtgatatacatctgtttgtccccactttccaaaagtatgaatcttgtctctggtttacctccaatgcctagaaaaatatgtggcagaacgcatgcttcagtaaataatcttttaatcactgaatatttcaagaattccacataattctataagacattattaactattgtaaatttttaagtggagaaaaagtactatgttgcctttatttcatgaaagcaaccttaagagttggcatgaacacatctatccatctacttgtgtttgtgctcatatactcatatcccacttactatggatgaatggaatgatctatcatctaaagtcaatatttctttttcctaacttccaatccaaggacattattccagaaatacttccttgtatgtcctacattatcaattttgccctctctgtggatgatttccattggcatgcaaacatgctgttattttttctcttcttatagaacattaaacacaacgatcttgactctacttcctctacaattacttgccttttctccattcctttttttgagtgaagcttcttgaaattgttgcctgtgcttactgcattcaacccctctactttgttctctcagaaatcccttttggtcaagctttctccttatcacttcacccaaaggactcttgtgaggtcatcagggctagccactttactaaatccaatggctgtttatcaggtcccattttatgtcaactttcagcagcatttgataaagttggccaccattttcttgaaataatgttttcctttggctttgtgaacatcatactctcctttactggttgcttttcagtttctttttctggttcctctttacccttctttatttttatttcaataggtttttgtggggaacaggcagtgttttgtatataagttttttagtggcaatatctgagatttttatgcatccatcaccagagcagtgtacactgtacccaatgtgtagtcttttatccctcgaccccctcccaccctttcccccaagtccccaaagtccattgtatcattcttatgcctttgcatcctcatagcttagctcccacttacaagtaacaatatacaatgtttggttttccatttccaagttacttcatttggaataatggtctccaattccatccaggttgctgtaaatgccattatttcgttcctttttagggttaagtagtattccatggcatgtatgttgtgtatatatatatacatatatacatgtatatatatatacatgtatatatgtatatatatatacacgcacatatatacacacatacatacatatacacatatatatcacattttctttattcactcgttgatcgatgagcatttgggctggttccttatttttgcaattgtgaatggtgctgctataaacatgcatgtgcaagtatctttttcatgtaatgatttcttttcctctgggtagataaccagaagtgggattgctggatcaagtggtagatctacttttagttctttaaggaaccccccaccctgttttccatagtggttgtatttgtttacattcccaccaacagtgtaaaagtgttcccttttcaccacatccacaccaacatctattttaattttttgatctttttattatggtcattcttgcaagattaaggttgtatcatgttgtggttttgatgtgcatttccctgataattagcgaggttgagtattttttatatgtttgttggccattagtatatcttcttttgagaattgtctattcatgtccttagcccactttttgatgagattgtttgttttttcctgagcagctacaattctttggcttgttattttagtggttgcttatggatttatagtgcatgtcttccactgatcacagtctaccttcaagtgataatatatcactttagtataagaaacctacatcgtatacttcttccctcctagtctttaagctatgactgtcatccattttattttacatgtcataaattccatagtaatttattatttttgtttaaacaataatattttaaagaggtttaagtaataataacaaatcatatatttgtccatgttgttactatttctggtgctcttcattcctttgtgcagatctagatttcaatatggtatccttcttacttttactgcctaaaagacatcctttaatttttcttgtagtgcaggtctccaggtaagaaagtcttaagtctttacaagtctaaaaatgtatttatttcttcatatccgttattctctttttggtagtatctagttggctgtgacactaatccattaaactttccatttcaattatggtatttttcaaatctagatttctatttggtaatttttcccaatctacttgattattttcatactcatgctctttaatccccttgtttctttacgtgtaagacacactttatgtgatgtttggtgactctaatatcttaagtctctgtaggttttttcctctgtacattgttcctgctggctcttgcacattatacatgtttgtaatttttgaataaaaacttacattccatgaagctgtcttccattttgcttttgccaggcacctggaaggcattaaaaacctgatgtcactttaaatttgcagcttgagactttttaggattatacagcttgtgtgtgaagccaccagtgaaagggctgcccatggttatgtattaatgtatcctcactctcgggcgagatgttttccctcaggatggacaattttgtctactgttccaggggctgcaggggatagaggtggcaggagacaggggaggcagacaggttgattcatagttccctcctacactaaacctatctttttggtgtcctttttttttttttttttttttttgagacggagtcttgctctgtcgcccaggctggagtgcagtggtgcgatctcggctcactgcaagctccgcctcccgggttcacacgccattctcctgcctcagcctcctgagtagctgggactacagacgcccactaccacacttggctaattttttgtatttttagtagagacggggtttcactatgttggccaagatagtctcaatctcttgaggtgtcctactttttgatgtcttctcctaatcctcctaccttggacaggatctaaactttgtctgctattctgctgccctatcatcatcccagactatgaaaagcaagtttcagtatgacacttggcaactatcttaagggtgaaaaatggcatctaattacttctttgggtttctactttcactttttaattttaattttttttgcctttgtgaactcttaattattttgcacctcattgatacatttttttaaaatggttcttgatatgtattccagaaatttttgttgttttctggtccttgtcagcccatgttgccggaaataaaattatttcaacttgttctttaacaatttacagtatccatatattccttcctgttccagaggcaatagagtgagaacacacacttaggagccaagctggcctgagattaagatccaccagcaatgtgacctcaatagcctatttacattctgagcctcagtttttcatagggttggtgtgataattatatgaggtaatatatgaatattacttaaaacagagactggtaaggatggactttcttgttattattatctgaaaaatttgaaaaattatgagcctgagtaacagttatacatcttacccattggttcactaacctctggcccctggctaccccagacccctctaccatgcagtcacccacacccatgcttacactgatggagaggagtcatctatgagctattcactggatgacaggcccagctactgtcacagatgcactccaagtccaggacagaatgctagcagatagctgctggtctgagaaatgtcatcatcatataagcctgagtgaaaacacaacccctttactactaagaaatctaaaaacaaacaaacataaaccaacataattttaaattttgtattttttatgatgtcatttgtcccaacagccatctgacatcaatagtcctgattactaaaaatctcaacacattatagaaatgttcttctcctttttgaaaaccatgtttatttttcccccacaatacagtgctatctgcaaagccttgaactgataacatagctcaggggctaactctatcttagcagagtagcagctgaaaaaagaaagcaattcttaacaaacagggagatcaggaatgctcacttcaaaaacattatttattcagggcaagtgggcaagtggtatttctgatgtgcaaatgaagcttaaacttcagctttaatttataagaattaggaaatgcagattaaatctctgatgccacattgtgaattcagtaaaggttaactaatctacgatgcaaagacaaactttagctatcctacacttattattctggaaatttaatgaaaattaaacaagaagactaacagagtataagaattgtccccccgtcttaacactgctgtttccagcctctgttgcctgaaacactgcagaatacttcagatttttttaaccccaactttttattgagtaaaaccaaagtactaaactaataaatgtgaaaaaggatgttgggcttaaaaagaaaaagcctcaagacatcgagcctcttagatattttaaaagtgaagaccgagaaggaatgcactgttgctaaatagaattataggattatggtcaatttataatcttttcaacatgggatttgaatgttctgatattagatacgatgtacgtactttatttatatagtacctcctgagaagaaaaaaaatcaatattggtttatacagtattttgcatgctattcacgtatgcagtgatgtatacgatatcagagctagaaaatggcttagatacgatttgtattcagcgctgggcgggtccggccccgccaagccccgccccgacaccacccccccccctgccccgcctcatcccgccccctccgacccgccccagccgcaccccttccccctccgccccgccccgtcccctccaccccgccccgctcggcttcgtcacctctgccccgcctcgacccctcccctcctccctgcctcgtcccctccgccccgtcccgccccctgaggcatgcgcggtgctcccggcaggcggggctggctgttggaggaatgtgcgaggatctccgtggccggtgtctgaagtcgtcagtttactgcttgtaatgaacatagtgatcactgggaacctggaagtagagactcctttgcgccgtcccgccgtccctctggctgctgcgaatccccccgccagcctccaggaccccgggctggctcaacgcccccaccggccccgccgccccagggcccgctacgcgcccggcataatgggagaaaaatcaggacggaaaggcccagcccctcgccatgcagacgggaagctcggcctgcacatgtgaggacccttacgccccttggggcttcaccccctttgctggctccaatagtctgggtcggggcctccttgtcctgtgggggcctctgggccacaagaacacaggcccgagccccggcgagctcgcgggcctcccaccagccgtgctcaggctgcacttctgcaccccagccctgcacctgcgggaccacctgggtcacttttccattctgataaagtccccgtacttcgtggctgcaggctcctcaagccccaggtctgtgcagggatgagcaaaacagcagaatatccgcgctacatctttctggagcacccattttactaccagatttggaaggaacaaagttaagtaatttccaggataagtaattaaaattttatgatgaaaaggctggaaactcttctcctggtaataactgtcagacatatctgtgcctgaaatgtcagactttctctgagaaaaaaactgagaacctgtttcccattattttaaataggaaacattatagggcacagcaagtcaatagaaaaaaacctaccaatttcctaattcacagtgtggcagtaggtttaagttgcacgtaagttagcaggtaaaatgcttaaatgttaccacgtggtcacccacatttgatatggttgttaacatgcagttgccttggatgcagtagctttggcttgagaccagcaacatcacacgtgaacctctcctttgtcaacacaccaaagctttttgaagtgaccgtcatgatcctgatggtctaccagttgtttctggaagcaacatgtggcttttccagcaaagtatttagtttaaaatgttgtaatttttgaaagctcaaacattatctctacaaccatcagccgaaaaatttgagacaggttcttgctcttttgcctgaactgcaccatgataggggctccagcgatccacctgcttcagcctccccagaagctgagaccacaggtgtgtgccaccatgcctgttaatttctaaattttttgtagaaattacatctccccacattgccgaggctggtcttgaacttctagactcaagcaattttcctgacttggcctcctaaagtgctggaattacagacgtgagtcaccgaccgcacctagcctgaaaaatgttttgtgagataaatagctgctatacagtttagatattaaaaactaagatgtgttctcccaggaaagtaataattttggatatattctgtgtcacatcctgtatgatgaaatagatggcaaaagaatcccatttaatttaaagatggaagctgtaacttcaagtaaatttggagctgaggagtcctttcgggctatgaccccagaattctggggttctctgtactgatattttgctagtgtccacacacaagcattccttaatgctgtgcgttaaacaaatagaccttctttgaccccagatttctctccatttaccattctgtttctctgctccatgcaactacctcacctcatgtcctctcttgaacccactcctttctagcttttctccagggtactttgctgaaacgacttttatctcagtcatttagctgcatttgacacagatgatacaattaaggagttcctccttgaaactctttcttctggattttaaagaccttccgtcctggattccctctcacctttttcttcatcctcctgctcctcctctaccagatctctagtgatcctctcagaatgatcccacatagtctcatagctttaaataccatccatctgttgataaccactaggcttggggcctcttccctgaggggagcaccaagagtcttccctgactcttttcccttcgcccccaacccccatgcaaccatacagcaagtcctgtggctcttgagtgcaaccagcaacctgattcaccatctccatttccacaaccagtttcagtcatcttcctctcctactggtctactgccaaaaatcctcctactgccaaaaatcctccaacctccctgcatcctatcttgccctcctgcagtccagcctccactcaagcatccagagtgatctcttgaaaatgttaaaacatgatataagcatacccccacccctgtgtaaaccctgccactgtctactcattgcagtagaataaaagttcagacaacctggtgcctgcctcttaagcctcatctcctacccttgcttgttcttgctatgtgggtcagattttccggtctccagagctgaaaacaatcttaactgacaggcattagatcatagactctatctacagcataaggcatggaaggaaaagtctgagagaatgaagggccagaaaagttcatttaaaaaaaataaaaagcacaggaaactggaaacataactaacctgtatgtatatactcaaaagaacatggcagcaaaatgaactctttagaaactgagccaacagacttgcaaatgaatagaaatacctttggtcctactctgaaaacaaaaagaatccttagtgaatatacaagaacaaaaattgtacacatttctgggtcataatgcaataaaactagaaataatcgaaagagaatttaaagatgttcagcttcctgaaaatgtcagattatccttttaaacaaattaatgcctatgtcagggtgcaaatccaaaacacaaataccttgcctataaaaatatattttttcaagcaacagtgtatcaggatgtaaggagagagctcactaactcagaagctcccagagtgaccagatgtgttcatgggaaccggagcactgccctggagtcatttgacatcaccttattacaaacaggaacagccatgatggggaatgctcagatgccagtaataagtcagaggattccctcctgaacgggacctcccagtcctttttggcacagggttccaggtgtgaccacaaatccatgggtgagggctttcaagatcaacctgccctcaggcagtggagtggaaactggaactagcagctacagtggaaaaaaggaatgtcctctcagaatatgtcatctgccccatgcaaagactctggatctcagaagtcctcctggtaaggactcggagccagacaacttcatttcctgtcacctgggctgctctccctctgacagctatggaaattggtgaagcacaggaacgtattggaaatggcaatgatgtgcaatgccaatgtgtggaagtgtacaagttaagtaatattttaaaaacagaacacacagcagtttgcacaatctgatcaaagctctgtcatgtatgtttctaaacaagtttggaagagaatttggaaatggctgaatttttttaataaagctcatgtttttagtttgtttaaatgtaaaagcatacacttagaaacaagttagtacataagaatttttaatcttagctatctggaagcttcaaatacctagaatgaggcatttcccaaaggtctctgtaacttgaattttaccgtagtttgaaaactcttgccaggcatactggctcacacaggtaatcccagcactttgggagattgaggtgggcagattgcttgagctaggagttagagaccagcctgggcaacatggtgaaaccccatctctacaaaaaatttaaaaattagctgggagtggtggcactgccgtttgacacagctactcaggaggctggggtgggaggatccttgagcccgggaggtccaggctgcagtgagccatgattgcatccctgtacttcaacctgggcaacagtgccagaccctgccccctcccccaaaagaaaactattagttcatagtgcagttgatgaaataatgtacatccacaaagaaaggagcaaccataatatgtatataattactcagtattaaaatattgtatatagtattacatatataatattgaatacctataatgaatggggcactgctttaagcactgtatactcattatcccacaagaattccttctcgggtaggtcttagtatattcaatttaaaggctaattagtaagcaatacatagaattgaacaagaagctaaaacatagaaggctctcgaaaatacaatgtggaatgagtaatgcaagttacagagatacatagcacatttatagaaagtgtaaaaacttacaaagttaaacactatattatttagataaacaatatattatttagagatgttattatgtaataaaagtataaaagtcagggaaataatatgttttgtaaagcttcagatgaatgattgtcctagatggggaggcaaatggttacatttccaaagggccaaccatgaagacggcttcaaatgtagtggtgtaggtgatggatacaatgtatttattttacttttatgtgagtctgtgtgtatgtatgtgtgtgagtgtgtgtgcaattttgtatgtataaatatgtagtaatttttttttgagtttgggtgtttctctgtctcccaggctgaagtgcagtggcatgatcacggctcactgcagcctccacctctcaggctcaagtgatgcttccacctcagcctcctgagtacctgggactacaactggtaaatattttgctattatagattcggctatcatgttctgttcagtgcctatttcaatagcctctctgccttaattcaccttcatctgcagtgggacacagtacttcttctctaggctacccatggggtaccccaacagcgttgccaccacatacaatcttcatagagctcttaactgcatccagctttctccaggagctcaggatgccccagaccctcatcgcagacagcattgccctggagcttatggctggagatgatatcaccacagacatccccaacccagccctgtcctgggagcaggattctggcctccctattaggcctcagaaactggctgaccacctggcttcacaaacctgtgtgttttcagggaaaattttgatctctacaaaccatgacatgtagagagggacacacatctgattcagcagtccctgatccgctgatccatggacacatttgcccacaaggaataacctagaatttctctctggtggaggtcaggggcattacatgagctgagtagagcttagtttttaatcactagacataggcaaggtgtttaagttattacgcttccaagcagcatggtcctcactcactcaaggtgagataaatattgctgcaaaggaacaacagctgcattgttggagttttgcttttgaggcgtgtgtgtgtgtgtgtgtgtgtgtgtgcatttgtgtgtgtgtgcgtgagttgatttctttcacaaaatacattttcacatacttccttactccaatctacattgccccttccttttaaataaatttttttgaaaactaataagcctattttatttatttacattttttatttacgtttctttacaaactgtttgctattagtctacagtgaaaagtcaacactttataaaataagattagcatttaaaagcttctcaattctaatactttgaaaggctacacccattttcagaaagtctgggctattcaaaatattttacaaaattctgaaacttcgaaaagctgcaagatttggagacagcaagatgaagtgttttttctaacagccagttttgttcactttattattaaatatgcactttttaaattaacagcttgaattctagaatatatttttgaaaatcactaatgatttttgtaaaaatagaaaatctgttgtacctttatcttaaaattcacttcttatctattttctagatttgatgttttgtcattttaaaggatactagacaagaggatctcaatttggatcactatattgggctcctaatatcctaatataattttaaatcatctcaaacaatgcattattaccatatacatcagcatttcccaaactgtgctataagctatgtatacttttgctatttttgagctaaaatatgcttacaaatatataaaaatataaaaatatatttaggtgttgttatgcaataatgcacttttcaaaaagaaacgatataccagtctcaagaatacccggaagctgcatgaaaattcttgattccttttatatatagtgacagaaaaagatgtaaatctaacaattggttatttttattgtttaaagttttttctataagcacatgtgaattaagtattcattattccatattcctcatgtcaccgacgctgggtgcccacagcactgtttttctaacactgcagctgtgggactgagggtggcagaccagacacctgcactgagccacattcgtcacacagttggaccagccctgagccgggggcagaaacatcctgatgtgaaaagctgtttgctaagtacaatgaccacacgtttcgtctattttgaatacaccatcacaacaaactctacactcttgacagatgagacaggcagatatgatctttgaacacaagtgagaaagacgttcacacagactcccatcctccctcacatgactggaggattaaaatggtggtggggggtggatattcagctcaggggcagattagtgacactctcacagctattttaagatacgaaatatttatatgatcctattccaaaccctaatacataaataatgaactcagaactgtacacaaagggaaacaaaaaaccactctgacagtgtccaggtccctcataaacttcccagaagtcaaggaggtcaaggctggtctcaaactcctaggctcaagcgatctgcccacctgggcctcccaaagctctgggattacaggcataagccaccaaacacagcctagtacgttctttcgatatgtttggaatgaatgtgtttccaaggataaaagcttacaatgacatctttcttacctgtaagatacccgaagagcagagagagggtccccaggctggctaagcatccagaacactgggggagctttaaaaacatagatataaattattgtatttcaccccttacttactgaatcacaatcccagggatggaagcacccagagatctgtctttttagaacttctccagctctccaagtggtgctgacaatcaggcagattgagagccagtgcttcaggcagctcatcccagacctcgggagcaggggagtcacccagagctatgtcagactgaaggttctggtgcatcaggggtggggagggtcttgagagttggcctttccaacaagcttcccagaggggctgctttgctgatcctcaccaggctttgagggtgcacagcactcttcctctaggtgtgtgtccacatacctggcacatttgttgttgcattgccccaggtataaagtgcagggtgccccctctacaccttcagccctgctgtctcccctgctgacccccaaatctctggggcttggacttacctttataaagggagctctcagctcaggggtgggccctccccactggccctcttttcccaaggcccggcatcagcaggagctgctcgagcaattcatcccgaggggtctatgtggtgtgaaaggcttagggagactgttctgtttattgttaagagccaggaaacaaagcctggaaacaaagtctggtattgctcaattcagtggtgataagagacaagggtagggcagggtgcagagaagactcccacacatagcaggaccgagtgagtgccaattcttccttctaacactggcaccaaggagagaccgctgtcccttcccataaaggcagtggacaaatggaagcatcgcttggtgtgccagcttctttggggcaggagaacaataggtgacttgaagcagggttgggagccccatcccaagcacagtggatgctgaagggggtcccaggctccccaggtcctgggcttctcttgattctcagttaagcttgttgattgcatatagttgaatatatataggcgaggaaaagacacaagccaagaactgggggcttcagtcagctctgaaaagtcaggaagagcatttcttttttttttttttttttttttttgtgacagagtgtcgctgtgtcacccaggctggagtgcagtggtgcgatctcagctcactgcaagctctgcctcctgggttctcgccattctcctgcctcagcctcccaagtagctgggactacaggtgcccgccaccacacctggctaattttttgtatttttagtagagacgggatttcaacgtgttagccaggatggtctccatctcctgacttcgtgatctgtccacctcggcctcccaaagtgctgggattacaggtgtgagccaccgtgcccagccaggaagagcatttctaacatccaaatgcaaatgtctgccaccccgggctgctttcctctggaaactgcactgcagggcacagcaggtcccaggtttgcctttcctaattccctgcaccacccagctcccgcctccctcactgtgcgggatgagaggtccacacagacagttccttctcacctttgaaatggcagtggtggctgcagcctgggagctgaggccatcccaagcgggtgagacccccaccaggggccctgggtacctgccggccacaggctgtgccatccaggctgtgcacagccacgcctcagctaccaggatttccttcctgtggaactggaccttccatccagagagtcttgcagcagagagcagaaatgggctttctctctgctggtgtaggaaagccatggcaggaaggcggtaccaacaacacacagctgcctgtcccacgtggggtcctgcacctcctgcctcccagctttcctgcccctttactttgtaagtgtgctctttgattaagtgtcctgtttttaattgtgtccaaatgttcacactgtcttaagtgatgctggagccacagcctggggccactgcaggtccttcctctggagcaaagggtctttgtcacagtgtttctctaaaagcatatccatcctgagtgacacttattttagaaacagatagaattggtgaaaaaagggttgagcattataaaatgtctctggatttcaaagaagttggccaccatctatggggaattggggatgagtaacttctctttaagtaaatgaggacaggacaggcatggtggctcacgcctgtaatcccaacacttcgggaggccgaggagggtggatcacttgaggtcaagagtttgagaacagcccggccaacatggcgaaaccccatctctacaaaaaatacaaaaattagctgggcatggtggtgtgcacctgtaatcccagctactcaggaggctgaggcaggagaattgcttgtacccaggagatggaggttgcagtgagccaaggttatgccactgcactccagcctgggtgacagggcaaaattccatctcaaaaaaaaagtaaatgaagacaaaatcccaaaggctagagccaccacccagagcaggttcaggatcgaagtgcccctgtggttcccctcccacctgaatgctctgttttaaaatgaaggtccaggacaaggggagagcatgtcattactaaggttcagtgttaaatagagacattcttccactgatggcagccattatgggccacctgagctttctttggttttccctgccatctgcatggtcctccactgcacttgaatgaggagtcctgagggtctgagtaagttgcagggattgctgtgctgccaggagtgagtgaaagaagaggccagagcagccacctcagctaaaaagaaagccagaggagagggtgggtatttagggagcggggatttttaatttcaagtgaattctgtaattaaggaaatggggtggtggtggtggggctctgggctgggtgctctggcactgtccctaacagcagtcacagtgatggctttgctcctgtgctgctgtccctcctccctctcagcaataggaagaacatgtgtgcttttgatgcacttggtgcagcaggcctgggatgccgcatttcacacaagcttcaggtgaccccagtgctgctggttcatggaccacgctgtgagtagcaaggtcacaaactcccctgagggaggggagtagctggctgcgtttctgagagaccctattacgattgaactactttgggcctcacttcttgagaactcaaaacagctgctgggtgtgctgaagccatattcaccccaccacaaagaggacagtcagcacctttctccacacaatggtaaaaaggttttgttttcatataaaacctcaacagatgaatggggccactatcaatgattttcagaaagaaaggctcaaataccaactattttttttatggagtcttgctctgtcacccaggctggaatgcagtggcatgatctccactcactgcaacttctgactcccaggttcaagcaatccactcgcttcagcctcccgagtagctgggactacaggtgtgcgccatgcctggctaatttttatacttttagtagagatgggtttcaccatgttggccaggctggtctcgaactgctgaaatgaagtgatccacctgcctctgcctcccaaagtgctgggattacaggtgtgagccaccatacccagcccccaaataccaactattctttaaaaaaaattatgattatgttggaggcacagtggctccttctgtaatttcaatactttggaaggccaaggcaggcaaattgcttgagccctggagttggagaccagcctgggcaacatggtaaaaccctgttcctgcaaaaagtttttaaaaaattagccgggcatagtcgcattcatctatagtcccagctactcaggaagctgaggtgggaggattgcttgagctctggaagtttgaggctgcagtgagctgtgatggcaccactgcactccagcctgggtgacagagtgagaccctgtctcaaaaaaagaaaaaaaaattttatatatatatatgtatgtatattatgttgggagagatgtccctcataattaaactaggttaatacagatgattttatttaatagctgaaatggttctgttacctgggagtttgttttatatttagttgatcttggaggatccatcatgaatcccccctagaagtgcccacagtgacatgttccatgagtgcttgatggaaagccatgtatttctaaggctctggtggcaggtagcagttatgcgatggcatgaggaaaatccatttagtagagttgtccaaaagtgcaatggcctggcttggtaagctgtaaattcagtccctgtgaggggtagaaagtgaggatggagaaggaaggaatatgccaaacaggggttgaacaagacgggcttcttccagctgtcagttttgtgactatgggtactgtccatgtctccaggatccacctgggatgcctctgataatgtaaccacgtacccccatttttcttgggcagtttattccaacaagtgagctatagtgcaggcattgggccatgtggtatctgtttgactttcaagggcttaggtcagcttggtggagttctctgggtccctctagggaatcatccaacccagggatggcctgcagggtcccaccccacccctaaagcacttacattcacacaaaatcctagagctgaatgttctcagcaggcttattcctcatagccaaaagccagaaacaaatccagatgttcttcaaggagcgagtggcaaaacagttggggtcattgtggaaatgaagggaagcctttggagagatgtattggaagaatgaacaggactcagtaatggattgtttatgacgtgggggggttacaggctgaagaaactctttctagagtctggaatggagtccctaggtgagctgtcacaccatttatttagacagtaagtctgggtcacagccaagtccaggaagatgacctagactatagagtgggatcagttctaatctgtaatgtctaagaggtatttcagtctggaaatcagctaggcagctgtacatataattctgagtggagataaaatctggaggttgtaagaatagagttaataattagtgccttaaaaatcaatttggtcacccagagggcttggggttctttttttctggcataccaataaaagaatagcagagttcaggggtgagttatgatgcacttcagattttaaatcccaagcaggggttgtaagcatgctggcaaaccttggggaggagcatccagaaaggcaggatgagaaggagaagcattggcttcaggagccaggagcaagatggaccccagaaacaaaaaggagccacttacctggactgttcctttgacgtggtaaatggaaagtggccattagattttccatcatggaactgtcaaaggacaaaagtacaacagatttagtttaaagatcctaattggctttatttgctattctagaatcaggcaacagttcattccataaaacagactgagcgttcctccgatcagagatggggagatgggctttatggatagaaaaggctgaagcagaaacagagaacaaaacacagattggttgcaaagttactttccttgtaaacattaaagcagaggggagggactgcctatcatgctggctaaacctggcctgttggggatttgcctgttatctctctgtgtcctgacttctcagaaagtcagatcaacaacttcgttttggtttggaaaagtggaactttagcgcaaggaactccaatccagtctggtcttgttactgaaatgaacctgggtctgcttgccccgtgtggtaaaaccaaacacccacactgaggtttgcagcaggagaaaggagggtgttaacttgcaggacaccaagcaaggagaatggggcagcttacacttcagacccaatctcctggatggcttacaagcaagggattttaaaggcaggggaacaattcaggaaagcagaagttacagggaaaccataaatcaatacagagggtatacattgttttggcccaaaaaggtggaagctcttgaagcaaggggcttacaggtcataggcggcttcaggattctttgattgcaattggttaaggaagccaggctttgttgaaaacttggggtcagcagaaaggaatgttaagatgtggcctgtgggcatgactccctccaggcccctgagaaagaaatttacaacaaagagcagccatcagagtgcagccctcagctccccgacatctgaggtctctgtgatgatggtcagtattttccatctgacgtgggtccgggtttctgaaaaaccattcatggacatatgctaagatgtaatctttagtttcaataggggaccaaacaccttgtggctctgacttacttgagtggctgttacttgaagctattattcccttcttgcttatcaggtggctcatttacttctcaaggccagctaggtacctggaatttcccttgaaggaaatcaagattttcctttgtttccatgctggaggaggcccagcaggcctctaataggggtccatgctccgtctcagtctgttgggcctagtgcagaagctcagtccaaactaatggcctcctgtaaatgtattttacagaagtcagcagtgtccacagcaagggagagtttcttgagcaacctgctgggagacctaagagtgaaataaagagtgaatgtcaggtgaaaacattgaaaagatgaggactgacaagtatttacagggggttaactctgaagtggttccaataaactgtgatcttgaaaagcaggtagtggagggaaaaatggcttccccttctaggttctttggctgggctaggaattaaattgacataagacgggctaataggagaataaaaaactttaattacgtctatatgcacaggagtcccacaaaatatggatgaggagaagggccagatgaatgaagcttagatagtgtcctgagttacagaaaggaacaggggcttggggcttgctgaggatgggcacaagttctgggagggtgaggggaggcaatgtctggtgaataaaaggtgtcttgttctgcagagaaaagtctctggggttatagaagttgtctggaaccagccctcttcctgatacagataattcactaatgtagattttttttatagttataaatttcttttacaaaagggcagcttttcagagctactcctgtgtctgcaatttcttagaataacaagatcaaaatttgcctaagaagtatattttgtgttcacatatctggttttgtattgtcatattttggggtggtgtgtcctgagccccaccagcaagggccatgttataggaatataatttttaattgactttttagagttgttttgaattcacagctgaaggggcttagagtataccatcccaaaatatgccactctgacataaagattattttgagctgaagacaactgagaccaagtagacacaggacaaactctctgccctgtccccatctaccagaagggcaggatggctcttaccagcccagaggtggcaccagaaaaatcaacatcacaagcacgccaaatcaaccttatctgtcagcttctgccatatatctaccttcccacaacttgttatccacagaagctcaaggtccccttcctttgtctttccacttctctacaaatacattgctctctcattagggtgctaataagcccaagttctaaccgcctttttgagttattatcactgagctctcccatgtgtatttgcgatgcatgaattaataaatgtgttgttttctcttgttaacctggctttcattggtctaaatttgtggggccaaggcactaaacctaagatgggtggaggaaagattttttctaaacctatacagcaaaattgagctgagcgtgcagagaactctcatatgaacccctcaccggcccacacatgtgcacacacacacacccacacacgcacagcctgccctactgtccatgtcccacatcagtggggcacatttgttactacagctaaacccacaccaacacatcattttcacccaaagtctgtggttcacattagggtcactcttggtgttgtattgtcagtgaaaagagccaaactctgtaaaatatttgaagagatttattctgagccaaatatgagtgacccaaggtatagtctcaagaggccctgagaacatgtgaccaaagcggttgttttacagtttggttttataccttttaaggagacatgagacattaatcagtacatgtgagatgtacattgattcagtccagaaaggtgggacagctcgaagggggtcaatgggaggaaggcttccaggtcataggtggattcaaagattttctgattggcaattgattgaaagagttattatctaaaaacctgcaatcaatagaaaggaatatctgggtcaagataaggggttgtggagaccaaggttcttaccatgtagatgaagtctcatgggggtcacccttagagacaatagatggccaatgtttcctattcagacttttaaaaggtgctagactttcagctaatctctagaggattgggacagcctggaagggaaaagagctagttatggtaatagagattctttacaggtgcaaattttccccacaagagacagctttgcagggccatttcaaaatatgcaaaaaaaaatcctattttggggtaaaatatttttatttccttctttatctgtcatatgatgttatacgagagtcaggtgggaaagtaagctgtgttatatataaggttaaataaagcccatctgttgagatgtcagtttctagggtatgactccccaggccccttagataggaatttgggcaagagagaaaaaatgtcagtttagtcctcagtacattctttgggtttgaacagatgtctaatgccatatccaccactgtcatatcatacagagtagtttcacagtctggcaaatcccctgtgctctgcctgttcatccctctctcccccaacccctgccaaccactgctctttttactgtctccatggttttgccttttccagaatgtgacagagttggaatcttacagtatgcagccttttcagatcagtttctttcagttagtaatatgcatttaaggttctttcatgcagctcaataatgtttggcagagactcaaaggcagggagaggaatgggaaatctgcggtggaaaaggggaagaggagtcctgatggggttgccagccaccagaggcggctgctagtgaagtggcctcattgtctggggtgacacccaatgttcattgtctcacagccacagagatcaagggcatggacacacaaagggtgaggttaagagtggaaatttaatacgtgaaagaaagagaatagctctctgctacagagaggggtcccggaaaaataggtcgctgatgcacagtgcaatgcaaagatttttatagatgagctagtggggagcagtgtctgatctacatcgggtgtgaaaaaacaggaccaggtgtgccatctgcatagggcacgaatctctggacgcccccacaccaatcttctatttattacgcaggtgagtagctactccatgttgcttatttctttcttactgtgcatgtgttaacaacaacaaaaaaaaaaaaaattagggaaggtgaaccccccatggtggacatgcctggccccaggtagtcctttttatcagtgtggctgcaggcctccccccaggcaagcttccagcttccttaactatgtttgcagctccatctttcaggctgctctttgttagaaagaaatgatttcttgggctgttttttgtcagaagttctgccaaggacttttttgccctatctgcctaaataatttatttccatctcctgtatccagtcaggggatcctacctgactggtaagagggtgcctatttggttctccctgttggtcctaggttcgaagcaagggcaaaaaggagggaagccgtcagtgcagtcctgaccattagggttgctgtatgcagtttccagctggttacttcacagactgtgggtcagagtgtcaccaggctctcgggtggattttttaaatcccacggactgaaacccttctttattatctccagtcacttgaacatctttctttgattgacagtttattcagtgttattaaaaaaaaaagctgctactattactactactactactacaattactatttataataatggtaataattatagtaatgatgaatcccagcaaggaccaaataattataattactgatttaatatttatacataaatatttattaaaatatataatctatatattacatatatttataccatgacatttatagtatctacataattacatattatttgtgtatttatgactatttatatttataaattacataataataagaagaatattattactatgactactataagcctcaggactccccccgccccccaccataacagaatatacccctttaaccatccagccacctaatcccacgttgcccccgctggtcgagcttgctatatataaaggcggctgccaactgttgcaagacaactagctaaaaagcctgccgaacagatcgggatcgcgggtgggcaggtaggacgccaggcctcgtccgggtccacctcaggtcacattcccacctcggggcaccctggcaggcatgagtggaaccgtgagatccctggtagccaaaagaagccttggaaaattttggggggagcgccctgggccagggacagctgccgggcaggggacagactccccagcgcctcccgggccagctgcccacccagagtggacttcaaaattcaccggggtcagcctgcctcagcctccccaggggcatgtagaaatttctgcggaccgaaagcccctcctgcgtcctcttcggaactataactgtttatatctaattgctatttatgtagattgattatttataaagtataatttatacttctacaaatttatattatttatattcatatagtttgtaaatgtaaataaattatttgtttataatacttgcttataagaattaccattgctgtataaacctcaggttccaccatccccctgcccctaccctccccttcgcaccttgccacgtccttctcccctcgccttggccccttctcctctcccaaattctagttgcccatctgcttggttgggctgctgatcgatctgatcaactttctgaggccacatcaaaactgcagaaatgaggctgatcgacccagcagctctaacaaagatcatccatcggacatctggtcgcctctctattttggagccagaggctgtacgctcttccccggtggggagggtggggccccaaagtccaaccacaagatcccattttgcaggccgcggctaaatccactgcgccttccccgttttttctcgaactgcccaagccagactccacctccaagacaagactcggaaaaaggtgtgaagctcaagtcggatgaccacgacccacgcgtggccacggacgggcccatgttattcttcgcagtcctcctgtaatggccgggcgggtcctcgcctccagggcggggcttggagataatgggtgtaatggaaggcctgaggacccggccccacgccagtcggagtccgggcggagtaacccatcccccgttcacactctcggaaggcccgtcgattcctgcgtgtactagtcgacccgctcaggccacagcactccgagctcaatagtgcgcctccaacgctgacccgcaggtttaatctccgacgaaaggacgaagagtacacccggcaaagccgggctcatcctgccagtgctgccagtccccttgaactctgcacggcgccctgtggccaaatcccctttcttgccggcttcgccagagcgccggagagaaaaccttaacagtgcagccaggtggcgcccaacagccggcgcaagcagccgcggatcggatcggcatagccagcgggcgaggcctctcctagtccctgaccacctgggatcgcgtttcttggcctgggccgggtggaggagctcccagttggcacggcctggaatgacgcgaccccgcagccgaaggggacttgaaaatttttcctaaccaccgttccgctccgagttactgctacctgctaggacagacctcccacgcggctccgggcctggcgatcttccgcgggaaccgggaacgtttccggagatccccgcaggccggcgccctgcctcggcttcccagtgcagcggggtcgcgggctccccgaggattccaaagttttgcggggcgcctgcggcgggagggaccctgaagttgaaactgtgaaaggcagaacgtgggtgaatcgcttttattctgtcttttcggagtgggaaagcctttctaaagcataaaataaacccagaagccatcaaggaaatgattgatcagcttgacaacataaagtttcacaagcaacgtcaaaagataacaaatgagtgtggggatcgcttatgcataagataagaatattgatttcattcacaatagccaagatacggaagcaagctaagcatctaccagtgggtgaacggaaaaagaaaatgtgatgtatgtacatcagggggtactatcccgcctttgaataaaaggaaatcctgctattggcgacaacgtggatgaacgtggaggccattgtactaagcaaagtaagccaggcacagaaacaaataccacttggtctctcctgtatgtggaatctgaaaatagttgaactcatagaaacggagagtagaactgtggctacctgaggccgggggaagggcaggagggaggagatgttgttcaaagggtacaaggattcagttagacaagaggaatatgttttagggatccacatgacacggtgactgtagttaatgcattttatatgtcaaaatccccaaaatagtaaattttaaatattctcaccacaaaaaataaatgtgttggtgatggatgtcttaattagcttaaagtaattattccaccaatgtatacatatatcaaaacatcacattgtatcccataaatgtatacaattatgatttgtcaattaaaaataaactttaaaaaatctttttaaaaagatttcagcattatttactataataacaaaaaaactggggtgggggtaatagccattgattaagaggggtcaggttaaataaactccagtacatccacaccatacactgtgtgaatttgttttgtttgttttagatgagataaatgttgatgatgaaatgttaaatgaataatttaaaacaagtattaagttacctctatttcaacacattaaatagctagtaaagactgtgtggtgtggacagagggatatgatctacagaaccgaaaagagaccaaaacaaatgcacccagctggtttttgacaagcatgcaaaagcaccttgtggcaggaaaggtagcctttccatcaaatgggagtagggcaattgcacatcacaggcagcaaacaagcaggcaaaccaaaacccttgacctagacactgtcaactttagaatcccaggcccccaccaaatgaatggaccccctcttggccaaggggacctcaggaaaatcttaaaagtttagttctagtctgcctggggtgggaggtcaaacatgcctcattataccccctgccttttggggtttagaccagcattaatgttaacatagagatcagaagactgacagaacagactctgtggcaataaaataccaagttataaacaggacctaaggccatgccaggcaagggttaagtcactaacactacgcctaaagaataaactgtgttccaaggaccacaaggcttttgtttttctctggcagctaaacaaccactggcctcaagatagacaagattaaaacaatttccagctccaccacccactgacttactaaacccctgctctaccagccataacttcctgataagaccaccaactatggattgtctttggctggtttacagaggctgcacacttgtgtgacttcatgccctgaaaagacctgttgacatataggacctaactgtaatacatttaaatgttaagtctccaccccaaagtgaacatggatcatatgctacatgcatgtctgttcaatatgcatgtgctaggaccaccttcatgaatattcatagctcctcctataacctgttgaatatgtatgtttagccaacctgcccagcataaagctcctaccctaacccctcctccttcaaagtgccgtttctggtcccttggctgagatggccaccttaaaggctgtaatccttatgagaaataaagtctcctcatgtttctaaatggataaattgtgggggttttaccctcacacctcatgcaaacattgactccaaatggatcacatatttcaatgtaaaatgtaaaactataaaattttaggaaaaaaaatcttagagaaaattgggatttaggctaaaaaatgagattttatacttgacatcaaaagcatgattcataaatagagatgggtaaattggaagtcatcaaaattaaaaccccaggctctgtgaaaggtccctttttttttttttttttgagaaggagtctggctccatagcccaagctggagtgcagtggtgcagtctcagctcagtgcaacctcctcctcttgggttcaagcaattctcctgcctcagcctcccaagtagctgggactacaggcgtgcgtcaccactcccagctaatttttgtatttttgatatagatggggtttcaccatattggtcaggctggtcttgaactccagaccttgtgttctgcctgccttggcctcctaaagtgctgggattacaggcgtgagccaccacacccagctgaaatgtccttttaagaggaggaaaacaaagtatagatcagaagaatatatttacaaaccatatattctacaggaatgtgtaaaaaaaaaaactcaaaacgcaacggtatttttcttcaaaatccaattacaaaattgatgaaagacatgttaaagtatgccccctgcagaaagacaaaatgactcccaggagactaactgagttgctcaaagttaaaatggaaccaggcggctgtagctgggtgacagagacttcatgtactctgtgttcttagaaagatgttataaaagtatcacaagacctcccttccacaaccaaaccaaaccagttcctgttgtcagtgtcaagataactgtatccggagcaccacttccctggacccctgacagccatttataagaaatttctgacagtcttctgcttaaggcttaaagaacaacaagtcagaactcccctgccctgactaatcaggactcaactgcatcaatcagggttcacctggatcgactaatcaggattcagctacatccaccgatcaggacagcatgagtttcagtccttcatttacataaatgaaagtagttggaaacctggacagaaacttttaccatagagcccaaaccctttcttagttttctagaacttactttccttttacactgaaggctgcaacttccccatttacaaactgttcactgaaataaagtcactttccacattccttttcagaaaacttagctcacagacacgaactagcatttcactgagcaggacgtacagatggcaggtcggcacatgagaagacgttagccttttgtgggagtgtaaattaaaatgacagtgagacgtcatgacacatccatcaaatgccttcaacaagatacaggaacagcatcaaatgcaggtgaggctgtggaggaacgggctttctcacacattgctggtggtaaggtaatattgtactgccactctggaaaacagtgtggcagtttcaaaaaagaaaacagcaacaacaaaaacatgcaagtgaagcgtggcagaatatgccaccccaaaatatgccactttagcataagggttattttgagctaaaggcacttgaaaaacagcagacacaaggaagatgccctgacctcccctttttcttcctgaaagtaggaggtgaatctcccatgggaaaggtgccctccctgtaccaggaggaaggaagcaattcttaccaccagaggcagggagttggggccgaggggaatctgtacaaacaaatctcgttaaactaaccctcatctgcctcattacttctccacgatgaactgccctatcccagactccattgtcttcaggttttcacaacttactctttgtccaacctagtatataagtgttcaggcctaactgcttcttcggatctctttttcctacagggttccattcacatgtgcaaatctgtgtgcttttctcctgttaatgtgttttatgtccacttacctcttaggcccagccagaaacactaacagtagaggtaaagttttgcttcccctgcataaggaccatgtaacccagcaaccaaacccctgggcattcaccccagagacaggggaacttgctgtgcttgaagggttgattcagtgcctctggggccgaggactccccctgacctctgaccctgggctacagcaggaattagaatatttcccagcctgaaactcctctttcctcaacttcagtcaaccagacaccctttgtggatggaaaaatctcattcagtgtttttataacaataacaaataataatggtaatcattacaataatgatgaacaacagcaacaataactattattattattaaccttgggggatgaaagggtagggtacagacctccacaatgctcctggagaatgaccacctactcctgctgggtcccagggtgggctggggtcagagtcccaggtttgcacgtgcaacatgctctgtgaaggcaaggggtgagcagcaggaggaaagggaaattaccctaacagggtgtggcagaccagtgaggaccctgggaggagaaacaggggagggatgtgcagggagagggacccaggtcgggcacccgctgcctggtcagtgagctgccaaagcttcctccacaagtgctggactccttgtccatgcctgcctacccggcccccggccagcaaaccgcgggcaccagctcatggtgcacagaaatatgcactccagatgaatcgcacacctcgatgttaaacgtaaaagagaaaacctcagtagagaatgctaagcgtttgtgtcccctggagaaatgttcttcagtgtggcacagcagaaacccaggtggtcagcagccccatctggtgtggtgccagggaagagcgctgacttgttagagcagcctggagttctgcctgctgcgatccatcacggcggcctctgcatctgcagggtaaggccttcaggtttagcactgcaaacccaggcatttggagtctgttgggccagtatcgctgctcaggtgcagatgggccagctgacttcacctgaattgtagctgccagccttcgtgagaagtgggggcgcttctgggaccggccggctggggcatcgggtgcaccatttctacttgaacacacgtcccccaggcacttggggcccccaacacggaaagcggccatgaggtgctgggcctccctctggctagggggagcaaggagacagcgagtgtggcagccaggactgggcctcagtgctcccagcgggtgggggtgtgacgggtgtagtcaggccaggtctgtggggaaggtttgtaggactggggctgggggctagccttgagtcctgagccacccaccagtggcaaactgcagttttgcagaggttaagcctccggcacctctctaaggcagctaggctgggacaggactggcaacagcagcaccaacacctgtgtgtcctgagcagggggtactgcactcaccggctccaaccagcaacgtcattaacgtttttctccactgtgaggatcatgcaaaccctaccagtttgattccaatgttttttgaaaaacatacttgaacacagagctgggagttttgacaggtaggctttaggagctttgtcaccaccaccaggacacagggatctcccggcaaggtgctcagggacctgtggggcccagaggccagggggctgggagggcctggagtggccagcagggaggctgcagagccatgcctcctcctcccctaatcaccccagcagaccttcctctgagaagcagcagaccagggagggggcatgtgtcattctctgccagtcactttcttctccactccaccacctatgcatttaacacagaaagtgcatgaggccacgctgtctgcagtcagccaccgccactgctccatccaaggactctgcactggaggccagcaggatgccctgggcttcctgcaggggctaagccatgcatgggtcccagtgcagtcaaggccccaaggcagtgagaaaggttcagcctggaggtgggtggttaggcataggtcctcgagagtccctttaaggtctcaatcctagtatcgcgtggggtcccattgctgtggttcaaatttctcagtctttcccttgattttgctggttttgcctctttacagattatttccttttgggttttctctacttctaaagaattttttgttgtaattatttcagacactgcctgagaattgagattttatggttttcaagagttacggttttcaatacatcttcatgttccctcatcctattctcctagaagttggctctgtgctgttagctgcctccacacatgtgcccttcatttgttaggactcaagtgtcacatctgaaatgggggctagcaaggtagatctgcaagacctatcccttggttgaagtagcaagccctggagtggcccagcaggtgctgataagctgacctgtgagagactgaatatacaatgacagtggctagactacataaaaaatcaaactctgagccataatctgcagcaaccagccccaaagccagcccgagatctgcagccacagcccaggaagccagcccgttagaagtcagatgtgcaggaagccagccctctagaagtcagacgtgcaggaagccagcccgctatctccagtcaatccagggagcttaacaccgccctgtaacaatcagcccaagacagtcagaacttgactaataacagcttccctaatttttgtcccggcttccaacttagaaccaaccagaaaaagtgaaatctactgccctaaccgaccacacaggaggccccatttctggtcggccaccccagtttccccaagccaacagcctccactcggagtgcacctggagcctcccctttttccactgtgaacctttcccatcctctgcctgcctggaaatttctaccaaaatgcaactggcgatggctgactcccttgctggggcctttgtgtctctcatttgagtggtctttgcttatctccatgctgcttgctatgctactacggatgggcatttcctgcccatccacgaagatttcacgtgcgtgcctggggtggcagcatacccaggtgcatttctcctgcctcctccttctctctttatcccgcagtcttcctcctcacccagctagccacaggtgtccacatggagcacagtctgaggagagagcagggtcaaacacagccaggttctaggtggagctgaatggggtttgacaggtgccaggtgctcccccagatggatctttacatcataaaaacgattttgtgcttgaagatgtggcttcagatccaccaagcataaagtcaccacctgaaattagaaagaaaacatccaataaataggccttcttcactccagcaaccctctccccatgtgccttctgaagctcctgcagcaagcctgcagatgggttcagaaagtgtttccaagaggagcaccacacagctctaacagacagacagacagacacacacacacacacacacacacacacacaccgagtcaacatgagggtaagaatgaggagagtgatggctgcagtgtctgagagaatttagtctcaaggattaagggaaggctccccaggcgagtgggaaaggtgagcagtgttcggtctctcagaggcgtggatggaagtgtcgtccaggcagaagacaaatgcacaaggcttgaagccggagcaaacagcttccatatgcaggagtgaaaatggcaggcacttctatggcaaatccaagagtgaggcaggagggttcagggcctagcatgccaggccagtgactttgtggaaccagcaaaccaagctaggcaaagtgtggcatgttacttccttataatatttttaattagaatcataatattttctctttaatgcaaagaataaataaattcttaaataatacctagcccaagggccactatccagagacactcaagctgccagaatttttaatgtatctttcaagaaatattttctatataaacagaagcctgagatgtatatgccattttttgtggtctcttccaccaaaacttcctcaaatgtattaagagcacaactcttgaaaacatgttcccactgaaacgtgcacacaaacgttcttagcagcatcattcattatagccaagaagaggaaacaacccaaatgttcactgactgatgaataaacaaaacctgctccatccacacaatgcgacattcacacgtgaggaatgccgcaccgtggtgaacaccagaaacagcaagttcagtgaaagaagcccgtcataaataactccattcatggaagtgtccagaataggcaaattcgtagaaatagaaagtagatgagcggttgcttaggtctggaagggatggggagcatcctgtcaggatgccgaaaatgttctgcaattgactggataatggcttcacggctctgtgaatatgctaccaaccgctgaattgtacacttcagtggtgaattgtttgaaatgcaaatgacgtctcactaaagctcttattaagaaatacatgagttgatggcagatggctatcaggattatgagggtgacatctcaggggaggagctgtgtgtgtggaggtgctagaactgcacaggacatcagccattaaagggtcctctgatctaaaaataggaattgtgatctgagtaattaatgagacactggctgtcctgaatttgcagctagtaaaaaagttgtgagtcaggaacaagcttggtttttccataacaggattttggctgctgtataagagaattggctggaagaagcaccattcacaagcacttactgtcaagaagcaagaagcacaaagcacttatcatcaagtaagaaggacaggactcccagtaagggggtagcagagagatgttggcaactggacagatgcacaatacacttgggaggcgacactgacagaacatgtctctggggacatgcaagaagaattaggtaaaagcataggttatatcagggtatgtcaaaaacagtgacaggagcaaataaataatctaaattgaggaatgctgatttgagaattctcagacatggattactgatggaaaagccaaactctgtaaaatatttgaaagaggtttactgtgagtgaatgagtgaccgtggcctagggaaacagtctcagagggcctgaggaagcgttcccgaagcggtcaggttacagtttggttgtatacattttaaggaggaaagagttctaggcaaagacataagtcaacccacgcatggacggtatacattggtgtgacctgaataggtgggacatcttgaagcaggggtttaaaggtcatagatggattcagagattctctgatttgcagttggttaaaggagtgagctctgtctaaaatttgatgtcaggagaaaggcatgttttaagttaaggatgctatgtagcaaggttgatggcctgcaggcctgaataaacccttgcctggcatggccttaggtcttgtttataatttggtcttttattgacacagaatctgccttgtcagtcttaagatctctaatgttaatgttggagagttgcacctaaactccaaaagggaaggagtgtaacaaggcttgggatccccttggtcaagagggggtctgttcagtcaatgggtgcggcttaggattttatttttagttcataggatggatcagattgtttttcttttgtgattacaaataaggctgaggccaagcatagtggctcatgcctgtaatctcaacactttgagggttgaggtgggaggatcgtgtgagcccaggaattcaagaccagcctgggcaatatagggggacctcgtcgctacaaaaaataaaaaaaataaaaattagctgggcataggagcccactcacgtggtcccagctgctcagaaggctgaagcaggagaatcactggagcccaggatttcaaggctgcagtgagccatcgttgtgccactgcactccagcctaggcaacagagtgagactgtctcaaaaaataataaataaataagcaaataaataaggctgaaatgaacagcctcatccatatcttttcatgaacacccaccaacttttccctccgaatagctttctaaagctttcgaatagcttatttttaagtcatgcaatgacttgacaaattgcgtgttaggaagcctgttacgaatttagactcctgtgctattttgaaatagatatttggtcttcatccccatccccacttcctggcaaaaagctcctaaaacccttggaatctgcagagtactaagagtgtcatttgtgtgctaatgaaatgactggtggctggggaccctagacagcttcaggatgggggctggccaccagaaagacagaggtgggattagggggttgggactttcacctcacttgccaacatctggggagaggagagggactgaaggttgagctgatcaccaattgccaatgatatggtcgatcgatcatgcctctgtaatgccgcctcagtgaaaacccgcaaggacagggtttgaagagctcccagatacctgaatacatggagcctggagggcggtgtgtctggagcaggtgtgggagctctaagccccttcccagatgcctcaccctgtgcacctcttccatctgcctcttcattttcatcctttgaaatatcccttgtaataaatgaataagtgtaagtaaagtgtttccctgagctctgtgagccactgtagcaaattaatcaaacctgaggaggggatactgggaatcctgatttgcagccagttgggcagaagagcaggtcacaacctactacttgtgactgacatctgaagcggggacagtctggtgggactgagcccttaacctgtgaggtctgacactgtccaggtagagagtttcagaatggaattgaattaggagacactcagctgttatctgctgaaggagtggttgatgtggagaagtctctacacattttagtgaccggtgatcagagaaacacaattatcctttggtatcttcaaatggattggtcccaaaactcctcccctggaagggttttggtgatttggacaccaaaattactggctgctcaagtcccttatataggaaagtatagtatttgcatataacctacacacatcctccacatgctttaaatcagatgtgtccaatcttttggttttcctgggccacattggaaggagaattgtcttgggccatacataaaatatactaacactaacaatagctgatgagctttaaaaaatcacacacacaaaaaaatcatatgttttaagaaagtttacgaatttgtgttggagggtaggccacagattggacaagttgctttaaatcacctctagattacttatatctaatacaatgtaaatactatgtaaatagttgttatattgtattgttcagagaataatggcaagaaaaaagtctgtatgtttagtacagacacaatcattctttttttcaaatgtttttgaatcgaggttggctgaatccatggatgcagaacccatggatatgaaggagtgactgtattctgtgtggaatttatgctgaatgggttggcagaacatacatattcaataagctataggaggagcaatgaatatttatgaaaggagaaacgtgaatgtgtcattgagtttcatgactcttcatgggtcatgtgttcatgggagggtgtagtttttagcctctgacatcaaaaggcgaaggaggggccaaaaaccactcactgtgcatcctctgtgagccagccaaaactggtccagaggcagtggtccattttaggaaggatgcactgtgaagctggtgactgtcactccaaaactacaaagaggtagggcgagtccagccacggcctcagatgattggctaaagatgataaaggaaggagtcctgtgtttcttgtttaccagagctggtttctgcttactccttaggaaagagttctggctaaaggttaatatggaagggacatgctgaagtctgtctgaccttgcatcccgtcctggccaggagctcagtttttaagatttctctggggtccctttggccaagagagtgttctatcagtcagttggggaaacttatgatttaaactttattccttgggtcagtttaatagaccttgcaactttaaaataagcattatcaggtctaagaactcagtgtgtgagcaccactcaagcatcacaacctgctgccaagatgctaaatgttgtaagaaaattaataacttaaaggcaaaaactgacctccatgaagatgaaaagtctgatggcactgtaactctagagaaaggagcatgtgtccccattgaggggaaggcagcgtccatttcagggcacactgcaggcatgtcagggtgtttcaggagtctgccaggtgtcctgtcttgtcactcgagactccagcccagggacagacagaaaaccagaagacagcacctcctggccaggatcccagcatccatttgagggagacaagatgagaagggacaatattgttgtagcaaaaataataggttctccacttccttacataggaggaaattcccacaccttgataggaggcagttccccttcctgcccaccttggcacaggcggtcacactccccacctgtatgttgagggactgtgcaagagggcagcactgtctgagttgggacatccacaaccccctgctcctgcccacccttggcttgagtgctggcgacggcaacgtcccctctcagccctggcctgaggtcctccacccttcttcagttctctctctcaggcctccatcatcccacagcttttcttccaatctctcctcttttttctttttgatgacgtttcaaaagagtcagcattttggaagacaactgtagacttgctttcaaatgcagagcatcagagagccatggtctgcccacaggtggcctgcagcagggcagagctgtgcctctgatggccaagggggaggtcacacttgctgcctctgtcctccttaatgctcctgtgacacaattagaacaaagcctgactgccgtgatgaagaagaggtgaactcatgctggtgggtgtcttgtccagagcacgtcagccaccccgtgagttggcagagccaatgggcagacacacaggatgaggttacaggaagatgctctcctgcagcagatccaaggagacagagaccccagcagatggcccgagaagctcccacctgcacctccagcatcaacaggcagacagagaactcctgttagaggggatgaggcaagtctgggacccttagaagactgcaggaagagctgcagatggtgcgaagcaggttcactaatgaccagtccaagggaggcctcccattgcatggagagcagcagagaccatcgctgcccctcccacaaggagtagttggtctggaatatttgctacttacaccttatgaatctcccagttactcgttggtgtgcttttaactaacatgagaagcagggactgggctgtttgttgagtattatgtcttgatattttttagttcagttgtacatgttagtaacaagggtaggggtgcagggtgtcctcatgcatggctgctataaaggtcatgagcaatcaaaaatagaaataactatttccattaattaggatattattgtaggatgaaggtggagaatgtatgctctgaacatgaaaaagagggcttggatcacagctctgccttctgatattttgtttgtttgtttggagcaggtgcttgatcctttaggtagaaagcaagcttagtgaagttaagtgattgtccaaaatcatgctgcttcttaccagttggctagaattcaaacccgagctgacttaaataagagcccaaatttacactggttatgtgggagaggggttgcttttgtttatttctcattactgtgaaaagacatcttatactcagtagaggatatagagtctatttttatactctaaaaattataatgacatgcacatgcatgtaccatcacccactggagacatgcaccggtccacctgcctttgcagctctcatttcacattccagccgcctgctacactcacgtcagcggtgcatagaagaacttcggttatttctcgtgtgagagttcaccttttgcaaaggctgacaggaagtggatgatgaagaactgagttttatgtaaaggagagggagaggtaattgatggatcatggctgagtgcaccgcagggaggaaggatggagggcacgggtggaggggaaggtcatcatggcagagacggggacatctcagatgagatgcccagaggtgtaacaactctgataggaagctgtgctgtgtgccacatgcctctgcaggctgcagaccagtttggatcttactggtctatgtatcaagatatggagtgagcttaccctctccagactgcaattcctgtgagtttctctcttctccttggaatctgagtttgttggttccagagtagctttccagctggggatctggggtgagatttcaccagccaaaggctgttggaaggcaaatcaggatgttgggtatgggctgggctaactgcagggctggactgagcactggaccctcagggtgtcacccctggggcagggtgggctttgggaagaacacagccctggcaggtgcccacctctgcctagtttgtgctggttgctatgggagtgaaggggccgccaagtggtagctccaggtggggctggccctccaaattccaggcctataatttatctggcacatataacccctcatttgaggcttaatttgtttccaaagccttgagtttgagagatcttacaaaacttttattttattgtcatcatattgtgacaagtgaagacatactccaacaaaaaattgaggataaactccagtttgatgagtttttcctccttttggtgtgttgatatcaaggacgctgttagacataaggattaatatcaggtctgcttttcagacactgacgcagccaggagaagggggacatggcctccacagagttgcaggtggagcttgccttgcagcaaggaatcccaggccaaactaagcagggcaagcagcaccattgagtgtcccactgcgtgattggtttcatgtgttgaagaatctacagcctggaaaacaagtggcagaaatctgaatggcagcatggtcacagacactggctggctgaggacttcgagactgttgtggtactttctcaaggcttctgttcccttactcatcaattagagttgacaatggacactgatccctgtctctcctgtggattcactgctacctggagtcaggagaagggagcgggaagcagtcaaatcctttagggccttagttcttgtggaccaacatgttaacaagtgcagctgtcccaagctctttgttactgtggtaggcagagcaatgcccctcaaaagctgttcccatcccaggccatgaaaccagcgaccatgttacatatgtggcaatgaggatatgcccctgcattgaggtgcggctctggagatgtcctgtatttcacaggtgggcccaagatgatcacaaagttcctaaccagggaggcaggagggccaggtcatagaaagagaggtgggcgtggaagcagaggttggagtgatgtggctgtgagctggagaatgtggacagcttctagaagctgagatggtgaggaacagtctccccaggagcccccagaaaggagcacagccctgcagacaatgtgactttagccagacagacccatttgggatttctcgcctccagaaatgtagcacaaacatgtgtggttttaagccagtttgtggtattcagccacagcagcaatgagaaacagacataacttccgtgtgattccttgacaggccacgtggctcaggactcctgactccttcctggctttgcttgcttgactgcaagacacagtagggctagacacctgctgcggtctgagtgtggcccccaaaagcatgtgttggaaacttggtccccagtgcaacagcattaagaggtgggaccttttattttttaaaataaaaaggttccatgaggaagagctgaagtaggtggaatctttaagaagacgtgattaggccattaaaactctaccctcgtgaatggatcaatgcccttatctcgggagtgggttagttatcatggtagtgagtacctctctctctctcgctctctctctctctctctcttctctccctccccctctctttgaccttccaccacgggatgatgcagcaagaaagccttcccttaccagatgtcagcatcttaatactggacctacaggtctcaagaactgtgagacataaatttctttataaattaccccatcagtgtggtactctgttgtagtaatacaaaatggactagacaacacataatgttttataaataaattgtatttgtgggatgcttttgtctttctaatctctccaacaaaagacaacttttgcaggcccacttctgtttgcaggccctctgaaaagccatctcaaaatatgccaaagtatcctttttctttttttccagagtccttttttccaatgcaccaaagtatattttgagataaaatatctttggttttctccgctccccactttgaaacttcaaatgtttcacatataaaaaggcaagttgatccctttggagagatttaggttagagtttgttaaataagagacaggcaaagaagagaaatgacaaatttgaatgagcagaaaagaacaaatttaaatattttgtctcagatcttgggacatttctatggaaacagaagaaaaacaaaggttaatgtctggaatagtgtatggactagtttttccagagtcgctgaagcatcttcaaattgtagtggtaatctgacagatttttctgggtattagttggaatcaggtgttccagcaaactttctgagtagtctatacatcaacaggtacaaaggctgtttacatgtaaagttgctacagtgatttctcctaaagtttatatcaagttttctagcatcaatttgcagggctttaagaaaagcacagtttttttatttctagtgattccaagtcagaaaaatgtgagaaaatgtgagaacattagcttggagacttgtagccagaaaagaattcagaattcagtcccagttgtagacaaataataaaaactgaaaaacaatggacagggctagagtagaatagtgggtatactatagttttcttctgaaacataacttttctctccccagttccccatttctaacaaagacaaatcacaataggaccaatttatttgcaaaataagttttcattttgttataattggcctgattgtttgaataaagtacagaaaaggtggtgattggccattcttttaagttggccttgctggaactttttcataaggaatttcagattagacttttaaaatcctctaaagtctaggaaaccaagccaagtgtttgccatcagactgtgcctgtaatgcctgtagaaattcggtgaattcctctcctcttgaggtcccaatatatcttgaggttcttgggcccttcagaaagtgacattctatacttactccaaggtacagaaccttgtaagggaactgtgtagacaagatacctggccagtctttctgcaaggatttttattagatctataaaatcaactttagttctgctgaataggctcatcatatctgaaaatatgccattcttgtcaaaaccttggtaaaataaccagtgtctcaattttgtcctgttatttaaaaaaaaaaaccaattctcactgagcttatgcaaagaactatattgacataaattaaaaatacttacaaataatttccaaattctagagaaatctgatagagagataaatgtttcaattttgttcaattgttaaaagctatagatggcttaagagaaaaaagttttcttgattctggaaatcaaagcatagaaagaatccacaatgattcaaaccaaagagtcaaaaaaaagttttcagtcctctatcagttcagtcccatgtaattaactcttgttctgcttgatattgggttagcaatcttcaggaacccatcaccttttcttatcagagttctggaagtttttgcctattccaacggtatgatatccaaacttaccataaatctgtatccaagagtacttgtcaaggactttttggtaaatttccttaaagaagaagcaagctttcgactatagtaaatcataaactgctttctgagaagagtcaaagtagaacaaaaattatctgtggatgacaaaagacttaaaataaccagggttagagaaacaattgacaaggaaatttggttatttatgtgacattcagcaatttaatataataatcataattattactgataacacatatgaagacatatcagaattttagtaaccccattccatttaggaacacatattaataacacatttttataactacaactcaaagacatttaaatacaatttttttatgtggccagtctttccatatgatttttgcataccaaataagactaatatgtccctcttggacttccaggagttcttcatgaaaatacttacttttataatttgaaattagatttttggaagttttccaaatatcaacagtttaaaacacttgataaaaaaaacaggatgaatcacaagcaactataaagtaatggtcattcattagtgatgattaccccaagtgataaagattttaaaaaccaaaaacttttactccttgatagaaaggagactctgtttcccaaataatcaaaagacctaatgaagacagcatgaagcaaacaaaatccatctctcccctcttttttgtgcagtttacttacaaggaaaacaaaaatcatttgctatctcttattaatactacatgaaaatagtgtttaaaagagaaaaccaaattctacctttgcaacagtgtattaatgctaaagctaattttaataaaatcttataaacagatcccttcaatctcagttttgatcacataaaataagattttcataaaccttttataacttcttgcattttttctatttttttccccagctgtccattcagttgtatgactttaaaacacctaacagagagaataaaaatctacctaattagacccaggcaaaaaatgtctaaattaaattctgaagatgtttctgttttatttacttttctttttatttatttatttatttttagagacagggcctcattttgttacccaggcttgagtacagtggtgcaatcatagctcactgcagcctccaactcctgggttgtagctgagatgacaggcatgcaccaccacaaccagttaatttttttttttttttgaggcggagtttcactctgtcacccaggctggagtgcaatggcatgatctcagctcaccgcaacctccacctcccaggttaaaatgattctcctgcctcagcctccctagtagctgggattacatgcatgtgccaccatgcccggctaattttgtatttttagtagagatggggtttctccatgttggtcaggctggtctcgaactcctgacctcaggtgatctgcccacctcggcctcccaaagtgctgggattacaggcatgagccaccgtgccaggcctacaaccagctaatttttaaaatttgtttttagagattgaggtcttgctattttgcccaggctggtctcaaactcctgggctcatgtgatcctcctgcctcagccacctaaagtgctgggattacagatgtaagccaccatgtcttgcccttctattttactgtagcaataacttaaaaactatctttatgactccgcatgtagtgcatgcctttaatctcagcactttgggaggctgaggcaggtggatcgcttgaggccggagttcaacacaggcctggccaacatggagaaaccctgtatctactaaaaataaaataaaataaaataaaatgccaggagtggtggcacatacctgtaatcccagctacttgggaggatgaggtatgagaactgcttgatcctcgaaggtgaagattgcagtgagctgagattgcaccactgcattccagcataagtgacagagtgagacagtctcaaaaaagaaaaaaagaagggaaatttctgttttttttggagacagagtctcactctgttgcccaggctggagtgcagtggcacgatcacagctcactgcagcctcgactacccaggctcaagaaatcctcctagctcagcctcctgagtggctgggactacaggcccatgccacaacacctggctaatttttgtagttttgtagagacaggatctcactttgttttgcagtgctggtctcgaactcctggggtcaagtgatcttcctgcctcagccgcccaaaatgctgggattacaggagattgtaccattggatcttttttttttttttaaaaaaggtaccccctcaagtggctcaccaaaaccagtaaggcttaatcaagattatgacttaaccaaggacacatgaggcatctccagagaggtgcacagcagtcctcaccagatccagaaccacctcaaagagagctcaaagaagggaaagttttgctagccacaaatggggtatgacccacatctgccagccatatcttccagggtctcagcctctcagctgaccatctacacacaaaagcctaagagccccgtgtaatccctcaaacagaagatgccagaaaaccaacagctgtctatggaagaggaaaggatcaatgacaagtgggtaagccacaaagtcaaaagtcacacaaatatcaaaccaaaagcgactggcttcccaactgggacctgcacccaggccatggcagtgaatgtgtggaattttaacaacaagactgcaaggtggggccaggtgcagtggctcacgtctgtaatcacagcactttgggaggctaaagcaggcagatcgtgaggtcaagtgattgagaccatcctggccaatatggtgaaaccccgtctctagtaaaaatacaaaaattagctgggcgtggtggcacgtgcctataatcccagctactctggaggcagaggcaggagaatcatttgaacttgggagttggaggttgcagtgagccgagattgtgccattgcactgcagcctgggtgacaagagcgaaactgtgtctcaaaaaaaaaaaaattgactgcaaggtggagtggctggcactgcagattccacaagggacccagggcaggcatttggagcatatgaaggattttagctttgtttcaggtcagacttttgctctttaatctcatcaagaggatttctaaggcaagccatgacactatgatgtgtcttttaatttaatcttccaatgaatataaataaggcagttgtttagaataagaaatctttaaactattttttgtaatttagaggtcttttcaacttaaagaatccatcttttggccgctaatgactagaatttccaataatgttcttattctaacatcaattccatcccacagcctcttcatggaaagccccggatgtggttttctaggcttagagtaggttattaccatttaagaaagacttgtttcctgaagagggcatagaataggcagttccaaagattcctccagtaaaattcactcctggaaacaggctcagatagcaagagacttcttttttattttaactcacagtttttattgattgaagtaataaaataaaaattagcaccttagttcctatttcttgtctattgtttttctttctttttaaaatttaattttatttaatttagttgtaagttccaggatacatgtgcaggcatgcaggtttgttacataggtaaacatgtgccatggcggtttgctgcacctatcaacccaccacctaggtatcaagccccacatgcattagctatttatcctaatactctccctccccaccaccaacaggccccagtgtgtgttgttcccctccctgtgtccatgtgctctcattgttcagctctcacttataaatgagaacatgtggtgttttgctttctgttcctctgttagtttgctgaggataatggcttccagctccatccatgtccctgcaaagcaacagactcttgttgccacacatggttaggatggtgtttgtgtgcacagtgcctctggtgacccacacatttctggggacacccatcacagaccccttaattcatgacactggacagctctcctaggatggaactttcccaggactaaccaggcaacaagggccagaccacaaaaattccttatggatgggacttcttattaagacaaacattcccaacagctggacacattcagaacaaaaagtttgctgcctaaaaccttgtatctcaggttcccaggcatcttcaggctaaacacctgatgggacccaaaaatcacaccccagatggcggaaacaagagacagtgctcccacttgtcacaagtcaaacactccagggcataaaacaagatgagaggggtcctcatctggcttctattttgtttttgttgttttgagactcagtctctcactctgtcacccacgctggagtgcagtggtgtgatcttggctcactgcaacctctgcctcctgggttcaggtggttctcctgcctcagcctcctgagtagcagagattacaggtgcctgccaccatgcctgcctaatttttgtatttttagtggggggggggggtttcaccatgtcagccaggctggtcttgaacccttgacctcaagtgatctgcccacctcagcctcccaaaggactgggagccaccgcacccggcttggcttctattttgaggacccacagcaaagtttgaatgcccatctgatcacagccacagactggctgctcttcaggtctggcctgaacaatgggctggcaggatcttcagcccccattctaccctacaaggccccttttcaggacagaacaacacaggaagaccaagacagacgagaataatcctcccggaaggaagggctctaaacaatatgagtattcacaccaaaaagtacaccagagtcgctgcacccaacactgttcacacagatcctttctcacactaatcaacatcttgcagaggaaaaacgactgatttttaccatctgctcacccagattccacagagagaccggccaggagcccggctggtaagaatttcttacccttctgccagctcgtcaggtcctgggtcccctgactgaagcttccagaaaagcaaaacagctttggtattctgttcaggacaccaaaactgtaggggccaacagaaaacctcccctttgcccttgaaagtttcactgaaaaatcaactcacaactcagattaattagagaaatggcatgcacatttattaatgtgcacatggagaaggaccagagcaatgatcccaaccccgcagtggtgtgcagaagcttatttaccgccttgagactacagaaggaacaggggctgggatgatggcaagacaggttagaggagagggaggaggaggcctggctcgcaaaggtggtctcagaatgcagacagaaccacacagacagcagtcctcagagagaatagatggtaaacatttctttctgatggctaaacatgtcagactctgagggactccttcctagatccagacaagggaaggcttcagaggaaacttgcctgtgtcagtgtggattctctacagatgcaaacgttcccctcaaaaggcagctttgcagggtggcctctgtttgaaggcccctctaaagagccatctcaaaatatgtccaagtatatagtggggtgaaatattttggtttccttcaactacatccttactacttaattcaatgcaatttcccttagccatgaactcttcaagtctttttttgcctgaaaaggttttgattgaattcataatcttgagtgatcaccatgtaagcagataaatattggttgacagttatatttcctcagtatattaaagaaacctggctcggtgcagtgactcatgcctgaaatcccagcgctttgggaggccaaagtggtgggtggatagcttgagctcaggagtttgagaccagcctgggcaacatggcgaagccccatctctccaaaattacaaaaattagccgggtgtggtggtgcatgcctgtagtcccagctactcgggaggctgagatgggaggatcccttgaacccaggaggcagaggttgcagtaagctgagattatgcctctgaactccagcctgagtgacagagtgaaactctgcctcaaaataaataaataaatctttccatggttgtgtgcatgttgagatatctgtcttgcctaaatttatttctctattttttcctatcttttattttgatgtaatttcagacattttaaaagtcacagcctggtgtggtggctcatgcctgtaatcccagcacttagggaggctgaggcaggtggattgcctgaggtcagtagtttgagaccagcctggccaacgtggtgaaactccacctctactaaaaatgcaaaaattagctaggcatggtgggcggcgcctacaatcccagctactcaggaggctgaggtaggagaattgcttgaactcaggagacggaggttgcagtgagctatgattgcaccactgcactccagcctgggtgacagagaataaaaaatgaagagttcatgtcctttgtagggacatggatgaaactggaaaccatcattctcagcaaactattgcaaggacaaaaaaccaaacaccgcatgttctcactcacagatatgaattgaacaatgagaacacatggacacaggaaggggaacatcacactccagggactgttgtggggtgggggaagggggcagggatagcattaggagatatacctaatgctaaatgatgagttaatgggtgcagcacaccaacatggcacatgtatacatatgtaacaaacctgcacattgtgcacatgtatcctaaaacttaaagtataaaaataataaaatgaaactaaaaaaaagagttgcaatagtagtgcgaaaaattccatttatgattccttcagattcctctcatattaacattcaattacatttgctaaatgctcttctcttggtgcagatgtagaatattatagctattttcctagaccctgtgagagtcagttgcagacatgatgctcctttacctacaagtattgagcgtgtgtttctgaaaccaagggcagctcttacattatcagagttcagtgatcaaaaacaggaaatcttcattgacacaatacaattctcagaccttcagatctccttcagattttgccaacggttccaatattgtttttataggggaagaagatcctgaaccatgccttcattcagttgtctcatctggaactgttctgcaacctctttgatttcttgatattgatgtatttccagatacaggctagtcacttaatagaacatccctccatttggttgcctgatacgtcctcacgttgagaatcaggttttgcactttcagcaggaacactacagaggggatgctgggctttttcagtgcaaccactaacaagaaacatgaagccagtttctcccctgctgtgagggtgaggtgggctttctccctggactgcaaccacctgggtgagtgtgttttataaaattatgctttctccactgtaaccttctcccatttccatttctgagtgcaaactatcttgtgggtggttacttttgagattctgggtctcttaaacactagttttggttgatttacttcagtatcacaatacttcagcatattatctactttcatttattcttggcactcattgtggttctggaatctaaagatcaatagttttcatcagttccagaaattccttagccattatccctttgaataggaccgttctctcattatctgcattttctcctcttgtaattattgtcaagtgtgttttgcatattctcatttcaattctccagtctcctgatgatctttcacagtttgcaaatctttattgctatatattctagacaattccacatatggatattcttataatttctatcatcatctgaggctaatctgttgtgttttaatttttaacttcactgatttcactattcacttccagaagtttcccttggtgtttcaaacaagcctgtcttctgtggtggcaatgtggtattttctagtgactgcagccattcttacctatctttaatccttttaaacctagttaaaagattgccttcttccttgttccctctgaatgttatcagcttcacattgctaaggtttttgaggtataattgacaaagtgaggtgtaattgctttattgaagtatagttgcctaagattgtatacatttaaggtgatgtgatgatcacagtgtgatgttttgatctatgtatatattgtgaactcattaccacaaccaagctaattaacacatctgtcacctcacacagtaaccttgtgtgtgcctgatgagaaccttaagatatgctctcagcaaatgtcaagtattattaactatagtccccatgctgtatattagattctagaacttattcgtcttgtaactgggagtttgtgcttatttatttatttatttatttatttatttttgagatggagtctggctctgtcaccaggctggagtacagtagcatgatcttggctcactgcaacctccacctcccaggttcaaatgattctcccacctcagcctcccgagcagctgggattacaggtgcacaccatcatgcccggctactttttatatttttagtagagacgaggtttcaccatgttggccaggatggtcttgaactcctcaccttagattatctgccctttttggcctcccaaagtgctgggattatgggtgtgagccaccgcacccagccagaagtttgtactttttggtcaacatttccccatcccctccactcccagcccctggcaacccctgttcccctctctgtttctgtgagttcaatttttttagatttcacatctaaaaacaggagttaggggagattgtgcaatacagtcaacccttgaacaatgtgagagttgggggtgctgacacccccatacagttggaaacgtgtgtataacttttgactccccaaaaacttaactattagtagcttactgttgcctggaagtcttatgtgttaatgtaaaccacagattaatacattttttatgttatacatattatacactgtgttctcatggtaaagtaagctagaggaaagaaaatgttattaagaaaaccataaggaagagaaaatctgtttactattcattaagtggatcatcataaaggtcttcatcctcatcatctttaggttgaggaggctggggaggagggagaagaggggttcatcttgctgtctcaggggagacacaggcggaagaggtagaggaggtggaagagaagaggcaggagaagcaggcccccttgctgtaactttttttgaggaaaattcacgtataaatggacccacacagttcaaacctctgttgttcaaaggtcaactatatctgcctttcggtgtctggcttatttcactcaacataacttcctctgggttcatccacagtgtcacaaaaggcaggatttccttcttttttagggtgaatgatattctattatctcattatatgtacatcacattttctttttccactcatccatgtgcgtacactgaggaagttcaggaaattccttccccgcaaccagaatatgccagtttgatgtgttgattgcttcaaactgagggcagtggtggaggagcaaatgcagggagggttttctgtggacctccctcatctgttgaaagacagatcttccaaagggaactcagctggcatgaatccccttcctgggaacctcatcaacaagggaagatttgttcatgtcacagcagcacagacagactttgtcactgctgtccctttttcattcttcattcttccggggatacatttatctttcccccaaataatttactctccctttggttgcctttgtcccctctctttctcccctttgcagaaaagtacataagcttccagcctcactgggtgttgggtttcacttttctttcacgtgatgcctcccgtgcccacatgtaaatttgtaagccttattctcctgttaatctgcctgctgtccattcatctcacagactcaattatcgaaccctctgagggtagagggaaagcgtttcctccccacaacacctgggttgattcagtatttcagctattgtgaatatgctgcaatgagcacggggatgcagacaactcttcaacaccctgaatgcatttcctttggatatatacccagtaatggagttgctggatcacatggtggctctatttttagtttcttgaggaacatccatgctgattttccacagtggctgtactaacttacattcccaccaacagtgtacaagtgacactgtactgtggtctgttataccctccttttctggctttcacattttgtctgtggtgcactcctcaaatgagttccgtggcatgccttgttcctgttttcactggaacatactgcacgctatgaggattatttcttcgtggaggcctggtcatacttggttgatgagcagaaggaccatttgccttttagaagcagatgtttgacttcaagtttaaaatcttctgtaattactgatcaaattaacatctccacaatactagttaacacttttcttaaaacgtcttttgtttcctaatactttttctacatttttgcacaaagttatttcattttaattactcttaatttactttaattttggaagtgagctttcttttcaacaatccataaatggttttttattttctcttttttcttgttcatattttcccaacattgtcccttatatatttccgtatagttaaccagatttatttcttatcaatctaatttgttttatattttaatcaatttatcgtttaccattatgaatttcttttttttcttactttttcttttgaaacagagtcttgttctgtcacccgtgctggagtacattggtgccatcttagctcacttcaatctctgcttcccaggttcaaatgattctcctccctcagcctcctgagtagcttgcattataggtgcgcaccaccacaaccagctaatgtttgtatttttagtagagatggggtttcttcatgttggccaggctggtcttgactcctggcctcacatgatctgcccacattggcctcccaaactgctaggattacaggcatgagtcaccacacctggccattttatcattatgaatttttgttctactttttccttttactttttttttttttttacagattttagtcttgttccagtttttgtttacctaacttcttcagttaaagttggcttattaaaatgttaaatttcttaggaaatggtaatctttggaggttaaaaagatttaaatttcttattattctcacaatgcacctaaaactatacagctacacattttttctcttagaacagcttctgttgtattctgaatatcttcttatgttgtactttcaatcctagataccttcttctctaaacttggtggatcttctgaaagttggagcagaatgggctttatagtttaaaaggtccactgctgtccagggatgtgaattctttgaggagggagttactgcacaaggaggtcgggagctgacggagtctgatgacaaggccctgggatgtaggagagggcacaaggcacagcaaagccagcctcactgcatgtccctggagcctgtgccaggtctacttcctggctgccagcttttccacaaatgctgtgtgcacctcacactttcagatcaggccgaaagatttctgtaggtcatgccaggaaagggaggttaagcaggcagctgtctaaggggtttgggggaagcttgggggagtcacaggattttgttgaagagagagaggtggaggagatggggctgtgtgttggggaggaaggttcagactggagatctagaaatccattagatcctctggtgggtcagggacaagagttgggggtgttgggggtataagtgggtggagaaggaggatttatggtgggagtggatttcaacgtctgctctaggtcagcttttggctccttaattttgttaagggatgttttaagactaaccatagtacattctgtgttcctctatcagtgtgatcttcccatagatgccagcagaccagttgtttagaacgagtactctctaacatgttttaaacatggatccgtctctggccatagctgatttggatctgcactggtgcatatgttccagtagtgccttaatctgcctttccagggaaaggccaggaggtggctttccatcattaccagcatgcaaggggtgttcctgcagtaggtgcagaagaggcagcccgtgatccaaaaattcactctcagagatggatgaagaaagcaaagacttacattgccatgtgcaggtagggagagtgtttgtgcagaccacgcctccagtctcccatggaagctgagacaccttcagcctcaggtccactcactgtgacactgggcaggtgatgctggaataggagtctcccagcactaatcagggcaacaaggataagatgaagaaagcccttatgaattggcatcttacaacaaaactccgtgagcgcttgacacatacagacagagagagtgccacctgggtctcatgtgtcttgagtccccagtctggtcagactgctgcctggcacagagccacactctgtgcccctccgatggcagagaccagagaggcatcctccttggtcacacagccaagctctcaggacataaaacgaggtgagaggggtaccccatcccttttgtttttttgtttcagggacccacagcacagtttgcttaggcagacatgggtctgacaagcacaacaaacccaagtgctggggacccagcagactttgaaggacctgtgcctgtgttctctacccgacacttcctctccttatgacaaacggcagaaaaagacagagacaaaggaaaacaaagaccatctttgagatcaaaaggatcaaatagaaatctaaacactaaaagtccctttttacccaaagaactatttcacaatgttttatcctgtcaatcccaatttagagagagaaaaagacacaaatctcaccattctcacctagatcagccccacagcagagacctggaaggctagcagtaagaaccctgcctttgctggcttaggtcagaggtcccgggtcttagctgcagtatctccagaataagcaatttcccagtcagtgagggagggccccggactctgtgccacgttctgcagggacccagagatcacctccaaccccacttagctcttacatgggctcctcagctggatctagaaaccaaattgaaatcaagcatattaacaagagaaaagcatacaaattgtattagtattaaaggtacatggggatcttcccaagttagtgaagtctgaagtagccaaagcaagatgcttttgtactttttagacagaatgataaatttgagaagaaatgacaaggccaagcagaatctggctaggggcagtaaatttccaggggagcctctaggtgatatgcgggaatataaaatcaatggcaacaaggcttacttcatgaagtacatttacttgggtcagttgctgcccccaatccccagtctccagtgctaagggctctcttcttgcccttgtgtgggggtgccacccccagaggagtctttatggcttgctacatgcaggaagaggcaggtcagctcaccctttctaaaactacgatttctccaatatttttgacataaaattatcaatataccaatttggcatattttgggatggcattcactccttcaagggaaaggtgggatggggaggtgtggggtcaggtgaggatgtggtgaaagacaaggtggggtatggatggaaatgggctctaggggaagagggaacaggcatggaaggggtgaggagagagagggccatgagccatgggtctggaggcagagagggaggcactggtgcaggtgataaaacctcacatgaggggtggcacaggtcagggggaaggtggaggccactggtgaggagactgggggttggcattgacaaatccacagatcccaaaggtgatggggaacagcagcgtcttccccggctccccacacagcagcatgttggcctccagatatactccatcacccccctgggcagggctcacacttctgacacccagactctacaatactcctctgtccccacccagggcagatccctaccctagaagttctccctctcatgtctggtaaatgctgcacagagccctggaattccacagggcaagttaggaagagggacagctgaaatcaggaagtaatcaccttctccaaagagaagttcagtccagtaccatcttgtgcccctgggcaagctctccaggctgagggaacaggagcagtggttatgctgggcaaagttggaagcaagggacctctcaggaagtgctgtagaatgttccactggggacacctcgtaccctaccaggattagaccttgaaacctggagatcccaggcaattagtattcaaggtcaaagggccagtgacaggaataggaaggcccactgtgtcattcacaaagcacttccaaacccatcaccccaggtgaccctcacaacaaccccgtgagatctgcagggcaggggctcccacaaagaaggagtcaggaatgtcgggattttaacaccttctccaagtcaggaccaggaaatgctgtcccagcaccaacttatattccctaggcttcctcccacaccacagcttagggtgactgccacctcatgggcagagaccctagctttccaatccttacaaggggctgtgcaggggagaggatgaagccccctcctctgactgtctcctctaagagcctgttttctgatgaaagtcactctgggaactgtcagcctctgcaaatgggggcctggacctcgtggaaagaagatgtgaaggtcacacctggcagggaccagctctggagggcaaacctcaccttttaaaattcccaacttgcatgtcctcctgccactgcattggtgctgacttctaaaggagcagcggacgtgaaaaagttgactttcttctaggttaacttcatgaagattattaaagtgatgaaaatatttatcctattctctataaagctccagcgaatatggttttctgcacatgcttatcaaagaatcttttagccaggagccctctgctgaagaacagtgtacaatctcagctgggacgcacatgttgcttctggaaacagatgaacacagtctgatcagagtctttcatgggtcagcgttgctccaggccagcccagcacagtcaggagcctcggcccaggcacgcccaagaagggagggtggctagtgcccagatgctgggggactgctcttttcgggtgctcttaattctgttaagaagccaatccatggccccgatgtcgtggtgtttggggctttaccctggcatcctgaacacacccagatagctgggtgtgagcactggagagaagccccggtctccactccacctcctgccctgcccaagctgctcccctggactgatagtgttctagtctctcctgagcattctcattcctggggcccctggggtccaatagtcaatttaggagcccatctaaagagactatctcttttagggggctggctttagggttcccttaccgatgaattggtaaatatggatggcagtggatgtagttgcatgacagaaagcacatcccaaccccacacaaaataatgagaaatggaaccaaagtcccagggctctccaagcacagaagaagccaccaaatattctccatctccatcatctgaagtgagctgatgcctcggcagctgggtgcagataacatgcagctcagtgcagagctccaggcccgcatcacaggctgtggaagggttacagattactcttgtgctcagaaggagacaaaacaatcagctctcccactgatcccaccccagcaggcccagcacccctcccagcttccaggccccaccaccctgctgccactacctattttctgtctccaaatttactttactgtaagttccttttcactctgtccatgacccagacataagcagggattccctcagagaaacagacttggatcccagctttggaggtctgaagatctccaggaattttttctaattctcaggcattaaaacaaatttttttggaagtataacatacagatggaaagcacaaatatcttaagcctacaatgcaatggattctcacaaacagtacactatgagagttgaactcacaccagaaaatgggatcaccccaggacctggaagcctctctagggcccctttcaagacatcacctatgccccgccccccccaccaaactttcctgacttatgattttccaggaacaattttatagttttcctgtgttttcactcaactaacatttacagtaatcctctgagataaacactgcactatcccccgttgcagatgggaagctggaagcacagacactggttattgatcaggtgcccactgctaagggtggagccagggtcccacgtggaagctccctgcagagccacattcttgaaacattgaactgcgctgcgaaaagccctttggctgcctgggcacagtggctcacacctgtaatcccagcgctttgagaggccaaggtgggatggttgcttgagtccaagagcccaagaccatcctgagcaacataacaagaccctgtctgttaaaataataataataataataaaattaaattagtgggtgtggtggtgcatgcctgcagtcccagctactcaaaagctgagatgaaaggaaaaaaaaaaaagaaaaaatcccttggcaagcaggaacaatagctcagttcaatgcaattgggtgtgtagaagaatcaccaccaagctctgggaaggctaggcagagggttttgcacacactcagggagtcctgtcctctctactgtggttggaacctgagaggggctgtgaggctctgagcaggagagagacttgcccaaaggccaaagacagggaggagtagagtctaacatgagtacaagattgactaggaccatcgtttatctctttacacaggaacaggaggaacttgaggcaaggaagggctatataagatgcagtcccctccctgcaggggccagcttggtgctggatgcatggttggttttatagtgacttgaactctgggactgcggcaggtggggccagatccttgactgtgcaggaatagacctcttccctgaaccgacagatgctgtatgaggaggggaggagggctgggaagccagccaggctggggtgggtgggcagagagtgttggggtttctcacctgtcctaacaaccacaaccacctttctggccttagaaagaggcaacagggagtgtgcgttttgtagagttcttcagggctgggcagagcccctgaggagatttgttgggggtggaaggacagaattcagatgaaggagacttggaaaaatgagttttaagaagttttattgtgggttatgatttcgataatgattagaattgcgtttcagggtgggcatggtggctgatgcctgtaatcccaaaatttgaagaggcaaatgcaggaggatcacttgaggccaggagttcaagaccagcctggacaacatagcaagaccccttctttgcaaaaaaaaaaaaaaaaaaaaaaaaaattgaaaattagccgggcatggtgtgacacacacctatagtcccaactagttgagaggctgaggcaggaggatcacttaagctcaagagttcaaggctgcagtgagctatgatcaaccactgcactccaacctgtttccaaaaaaagacaagaattacatttcagtataatgaaatcataatttttaaaggtaaatactataacctttaattgagagagaaaaagagtttgacagcttcaaacttgatactggcataaaaataaacaaaatagcccaaaagtccttgtaaatattcatgtatatataggaactgataacagaacaaaggttgttttccaaagaaatgagggatggctcacaggttcattgagtattgttgaggaaataggctatccatctttgcaaatgctcagattattcctaccacacaatatacagaatctagttgctgtataaggaagaagagggtggctctgggcagacacctgtgtttcaatcccagttttgctctatgcacctctatggcctagagaaagttaccctacctctctaggtatatgctatccagatcttaagcgggtttaagaaaatagctaggctggtcatggtggctcacacctgtaatcccagcactttgagaggcagaggtgggagaattgcttgaggctaggaattcaagaccagtctgggcaacacagtgagtccctgtctctacaaaaataaaaaataaaaattagatggcatggtggtgcataactgtagtccaagcaactcgggagtctgagacaggaggattgcttgagcccgggagttcaaggccacagtgagctatgattgcaccactgcactccagcctgggcaacagagcaagaccctgtctcaaaggaaaaagagagaaagaaagaaaggtagctaaatcatagaatggttctgataaactgggctctagatgtgaagaccttagaacaatgcctggcatgttcagtaaatactatttccccatatccgtctattaatagcacgctaaacataggaggagaaggccacacaagcaagtgggttacaaacttctggttctgggtaggactcaggagcagagagagatagatgagggatgatggaggatagcagtggactcactaagattgacttcctggctcaaatcttggagaggaaaagggaaaatcccaaaggactttggccatgggagttttgctgctagtattccagggcatgtcctgtgattcatgctcgttaagacaaagaattttatagcagttgccatcccagaaaattcctattccagcttccctgggccacaggtgagacagaggctctctaaagtcaacccgcaggtttggcttcttccatttacctgtgccctttctttcaacaagaggcctccaaggctgccacgatggagaaaagaaatggggattacacaggagacagttctgtgagccaagccccaaagcggcagcctgagcttctgcccacatcataccgacaaggactcagtcctgtggctcctgctactggcagggaggtgaagtttccctgatctgcaagaggaacatgagtgggttaggtgagcaatagcactgactgcaccagcatgccttcaggtcagcagattatcatatttctgttgccactacacaccaataaaacagaaactcactctgtctccaaggtggccatgcaaaggactctctagtaattccatcctgctcaaagctcaggaccattggctcacacagagtcctctccaaagcagcaagatgtggccctgtgcagccaggagacagaataataacctaattcccattcagaacatgcagaacatggaccaaggagaaacacagaataatttgtgtagcctacggggctggcaatgggaagatagtaagaatgttttccttgattggacatcaagtctgctctctggaattaagtccattttcattttgttttctcctcttgtgcctggctctcctctccaaggaattcatcattgtctgttaccatcttggtcacttctgaagtgggtttgggggaaaaagtctctgtgggagctgcaagtttagcagcctacttccttgcaaagatggtaccaagacttgcctatgggtccaatggttttagatcctgctctgcatttagacaatgctcatagctgctttgcaagccaccccaaaccttggttaactcacatccctgtgtttccagtcagttccatgagccaattaccacaccccaaaggcctttctttcttggacataattctcaagactgagccttggtagattggacttctaaaatactctcttactacttggggtccagaagcagcaaggtttttccaccttacaaagtctgatgtttctggattctcttgatttctttttagttatacttacatactgggaaaattattgaactcatcttcctccaattacttgccaaatgcatttatcaatatagaacacacactactaacattgtttatcaaactcttcccttatagtcacaagttcagcagcaggtgcataatctgccatctaagtaactgcaagtgatgactttaccaaaggctttgttatcacttaagatggattcagctttcattagaattattcatcaaaataatataatacaaaaaccaaataaaatgtggctacaccataaattttggtaaatgattagcaaatataaaaattaaaaaattttggaacgcttctcttaatgagacagatggacttctgtcccagctttgccatgaatctgtgaatgaacagttacctgctagaatgtgacagagttcaacatcagtcatacacctattttttcacttgttcagtttgaagtcctgagaaaccttgcttacataaataagcagataggaatggaaagggtctttatgcaattatttgaactctttcaaagttatagaccaaaaagcacagttatatataataaaagttattgtaaatgacccatctgctgacaactggatttgttccaccttcagtttgttcaaatgaagaattgaaacttatgtgactcgtagtgggatttgatatccaggaattaaagacagtctcacctgaaatacctacttcagtattttaaattatccccttgttaatccctggagatatggatctatggtctatagtaagatgcaagattgttgaaagggaacctcttgtgaagtgggagaagggctattctaaatagggactctttgatctcatgctagatcttaggaagatcatattttggaaacagcccaggtagaagttaaagatctgaaaattaatttctttaaaaccatccatgggaaagttctgagttaggaattccaaaggcctgccttctaccaaaacagtgaaaccactggcaaaaaactgtcaaaatcactctttatagaactctggaaaagcttgcagcaagcagtagagcacatattcaagaaaaactgctgacaccaataagaaaagcttgctccagggtgctttagcttatcctggttccatctcctgcttcccttgaaaactcacagctgttgttcccagtgtggtactgaacagatcagaaatgaagatattctcagagagttggaactgctcattttgatctgtcagattgctccccagaagactagctccaaaggattgccattctcttgtccaccttggaactcaccccaaactgaagcaccacctcagagcaattgttgacaacatatatggcaaatgttccaggcccaactgccaaagggaatggacagttgctggggaaaacaacaggttaaccaaaacttactgggagaaaagtctggaaataagatgttttaggcaacaagggctttggaaaattgttacaaattcctgggaatcttgaaggccgcacacatgcccagggctctgtgcaccctcagagaagagctcagacagctctaagctcacccttggctgatcatgaggttcaacacaggcaggaagtgaaggttaagaccaggttggaaaccacctggctgagcattgaaggaatgacctcaaaatgcaaacacttcctctgcaaagattagatttttattttattttattttatttctttagacagagtcttgctctgtcacccaggctggagtacagtaacatgattatagctcactgcagcctcaaactcttgggctcaagtgattctcccacctcagcagctgggaatacaggtgtgtgccaccacactcagctaattttgaattttttgtagagacggggtttcacgatattgcccaggctggtcgtgaactcctggcctcaagtgattcacccatctcagcctcccaaagtgctggcattacagacaacagccaccgcacctggccaagattagattttttttttttttgagacggagtctcgctctgtcgcccaggctggagtgctgtggcacgctctcggctcactgcaacctctgcctcccaagttcaagcaactctcgggcctcagcctcccaagtagctggaactacaggcacccaccaccatacccagctaattttttgtattttagtaaagacggggtttcaccatgttgcccagggtggtcgtgaattcctaagctcagccattccacccaccttggcctcccaaagtgctaggattacaagcatgagccaccattcctggcctaaaatcagctcttttaagtatgtccaaagagctacaagaaaccatgttctaaagaactatggtgaggacgaaaacagtatctcaccaaatagagaatattaacaaagagatgggaattataaaaagaaattcagaagttaaaaagcacaataactgcaatcaaaattcaatggaaggctcaccagtgcatttgatcaggcagaagaaaagaactgacaccatggtttaggtcacagcatcccagatgctgcaactagatttttcctttcttaggaaccttggggtccaagggttgtagtcccactggtgttcaacaacacacggatcaatgtgtgtccatgcagtacatttaattccgaacccccatttgggggtactgtcaggcttatagatgccttcatatacatacattatgagatgctaggatattcctgctgctcattactaggacagagctccagctgccatttcaacaaaaaatcccaaaaagtcaactaaattcaacgccttcatctgcactcaatgagcctgtctgcccagtggggattgtggacagagcagaagcattatgacacgttacgtgttggggtttttagtgctaagtttgtgtgatgagaattgctgaaccctctgatgtggggtgagtcattaaattgtctcccctgccactgaatagattccaacatagcctggccacacgtccaagggtgtgggggacagagggggagccgaagcactgatgctccctgatcctttgatcagtcaagatgactaaggtgggtgcacacagaaggcgggggcaggaaagtgctggggtggatgttggagaaccgacactagtggagctaacccaaaatcactaaatcagggatttcagatggcgtctactgttagggagatgagaatcctcatgtgagatgagtcaggttctcctgggaattgccatggggcagggggttgggggggagttaaatggcactcctgaacactagggctaattaataataaagccctatatttccattttactgccaatcacatggagacataaacatcttcctgatgggagccatagccaaagcctttccacttgcaagagctccgacttcccttcagtgcatgcgggttgaccagggagactacaagagggggcaggggtgagattcgtggcaggtgagcctgggagcagagcagagagaagcactgttgtaccatggcttctttttccaattttgctttttttttaaattatactttaagttctagggtatatgtgcacaacgtgcaggtttcttacatatgtatacatatgccatggtggtgtgctgcacccattaactcgtcatttacattaggtatatctcctaatgctatccctctcccttccccccaccccacgacaggccccagtgtgtgatgttcctcttcctgtgtccaagtgttctcattgttcaattccaacctatgagtgagaacatgtggtgtttggttttttgtccttctgacagtttgctgagaatgatggtttccagcttcatccatgtccctacaaaggacatgaactcatccttttttatggctgcatagtattccgtggtgtatatgtgccacattttcttaatccagtctatcgttgttggacatttgggttggttccaagtctttgctgttgtgaatagtgccgcaatggacataagtgtgcatgtgtctttatagcagcgtgatttataatcctttgggtatatatccagtaatgggatggctgggttaaatggtatttctagttctagatccttgaggaattgccacacagtcttccacaatggttgaactagtttacagtcccaccaacagtgtaaaagtgttcctatttctccacatcctctccagcacctgttgtttcctgagtttttaatgatcgccattctaactggtgtgaggtggtatctcattgtggttttgatttgcatttctctgatggccagtgatgatgagcatttattcatgtgtctgttggctgcataaatgtcttcttttgagaagtgtctgttcatatccttcacccactttttgatggggttgtttttttcttgtaaacttgttggagttcattgtagattctagatattagccctttgtcagatgagtagattgcagaaatgttctcccattctgtaggttgcctattcactctgatgatagtttcttttgctgtgcagaagctcttcagtttaattagctcccatttgtcaattttggcttttgttgcctttgcttttggtgttttagacatgaagtcctttcccatgcctatgtcctcaatggggggcattgcctaggttttcctctaggatttttatcgttttaggtctaacatttaagtctttaatccatcctgaattaatttttgtctaaggtgtaaggaagggctccagtttcagctttctacatatgactagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggctactgtagccttgtagtatggtttgaagtcaggtagcgtgctgcctccagcttttttcttttggcttaggattgtcttggcaatgcaggctcttttttggttccatatgaactttaaagtagttttttccaattctgtgaagaaagtcattggtagcttgatggggatggcatcgaatctataaattaccttgggctgtatggccattttcacgacattgattcttcctatccttgagcatggaatgttcctccatttgtttgtgtcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcttatcagcttaaggagattttgtgctgagacaatggggttttctaaatatacaatcatctcatctgcaaacgggacaatttgacttcctcttttcctaactgaataccctttatttctttctcctgcctgattaccctggccagaaattccaacactatgttgaataggagtggtgagagagggcatccctgtcttgtgccagttttcaaagggaatgcttccagtttttgcccattcagtatgatattggctgtgggtttgtcataaacagctcttatgattttgagatatgtcccatcaatacctaatttattgagagtttttagcatgaatggttgttgaattttgtccaaggtcttttctgcatctgttgagataatcatgtggtttttgtctttggttctgtttatatgctagattacatttattgatttgcctgtgttgaaccagccttgcatcccagggatgaagcccacttgatcatgatggataagctttttgatgtgctgctggattcggtttgcagtattttattgaggatttttgcatcaatgttcatcagggatattggtctaaaattctcttttgtggttgtctctctgccaggctttgttatcaggatgatgccggcctcataaaatgagttagggaagattccctctttttctattgattggaatagtttcagaagaaatggtaccagctcctccttgtacctatggtagaattcggctgtgaatctgtctgttcccagatgtttttttggttagtaggctattaattattgcctcaatttcagagcctcttattggtgtattcagggattcaacttcttcctggttaatcttgggagagtatatgtgtccaggatttcatccatttcttccagattttctagtttatttgcatagaggtgtttatagtattctctgatggtagtttgtatttctgtgggattggtggtgatatcacctttatcattttttattgcatctatttgatacttctgtcttttcttctttatcagtcttgctagtggtctattaattttgttgatcttttcaaaaagccagctcctggattcattgattttttgaagggttttttgtgtctctagctccttcagttctgctctgctcttagttatttcttgccttctgctagcttttgaatgtgtttgctcttgcttctctagttacttcaactttgatgttagggtgtcaattttagatcttttctcctttctcttgtgggcatttagtgctacaaatttccctctacacactgctttgaatgtgtcccagagattctggtatgttgtgtctttgttctcattggtttcaaagaacatctttattcctgccttcactttgttatgtacccagtagtcaatcagcagcaggttgttcaatttccatgtagttgagcggttttgagtgagtttcttaatcctgagttctagtttgattgcactgtggtctgagagacagtttttataatttctgttcttttacatttgctgaggagtgctttacttccaactatgtggtcaattttggagtaagtgcgatgtggtgctgagaagaatgtacattctgttgatttggggtggagagttctgtagatgtctgttaggtctgcttggtgcagagctgagttcaattcctggacatgcttgttaaccttctgtctcattgatctgtctagtgttgagagtggggtgttaaagtctcccattgttactgtgtgggagtctaagtctctttgtaggtctctaaggacttgctttatgaatctgggtgctcctgtattgggtgcatatatatttagggtggttagctctttttgttgaattaattcctttaccgttatgtaatggccttgtctcttttgatatttgttggtttaaagtatgttttatcagagactaggattgcaacccccgcctttttctgttttccatttgcttggtagatcttcctccatccctttattttgagcctatgtgtgtctctgcacgtgagatgggtctcctgaatacagcacactgatgggtcttgactctttatccaatttgtcagtttgcatcttttaattggagcatttagcccatttacatttaaggttaatattgttatgtgtgaatttcatcctgtcattatgatgttagctggttattttgctcattagttgatgcagtttctttctagcatcgaaggcctttacaattcagcatgtttttgcagtggctggtactggttgttcctttccatgtttagtgcttcctttaggagctcttgtaaggcaggcctggtgtcacaaaatctctcagcatttgcttgtctttaaaggattttatttctccttcacttgtgaagcttagtttggctggatatgaaattctgggttgaaaattcttttctttaagaatgttgaatattggcccccactctcttcaggcttgtagagtttctgctgagagatccactgttagtctgatgggcttccctttgtggataacccaacctttctctctggctgcccttaacattttttcctttaattcaactttggtgaatgtgacaactatgtgtcttggagttactcttcttgaggagtttctttgtggcattctctgtatttcctgaattggaatgttggcctgccttgctagattagggcagttctcctggataatatcctgcagagtgtttttcaacttggttccattctccccatcactttcaggtacaccaatccaatgtagatttggtcttttcatgtagtcccatatttcttggaggttttgttcatttctttttattcttttttctctaaacttctcttctcacttcattttattcatttgatcttcaatcactgatagatttcttccagttgatctgaagcttgtgcattcatcacgtagttcttgtgccatggttttcagttccatcaggtcatttaagaccttctttacactggttattttagttagccattcatctaatcttttttcaaggtttttagcttctttgcgatgggttcgaacttcctcctttagctcggagaagtttgatcgtctgaagccttcttctctcaactcatcaaagtcattctccatccagctttgttccactgctggcgaggagctgcattcctttgtagggggagaggcactctgatttttagaattttcagcttttctgctctgtttttttccccatctttgtggttttatctacctttggtctttgatgacggtgatgtacagatggagttttggtgtggatgtcctttctctttgttagttttccttctaacagtcaggatcctcagctgcaggtctgttggagtttgctggaggtccactccagatggtatttgcctgggtatcagcagcagaggctgcaaaagagcgaatattgctgaacagcaaatgttgctgcctgatttttcctccggaagcttcttctcagaggggtacatggctgggagaggcgtcagtctgccgctactgtgggatacctcccagttaggctactctggggtcagggacccacttgaggaggctgtctgtccattctcagatctcaaactctgtgctgggagaaccactagtctcttcaaagctgtcaggcagggacatttaagtctgcagaggtttctgctgccttttgtttggctatgccctgcccccagaggtggagtctacagaggcaggcaggcctacttgagctgcggtgggctccactcagtttgagcttcctggtcactttaccaactcaagcctcagcaacggtgggtgcccctcccccagccttgctgccacctcgcagttcaatctcagactgttgtgctagcaatgagtgaggctctgtgggcatgggaccctccgagccaggggcaggatataatcttctggtgtaccgtttgctaagaccattggaaaagcgcagtattagagtgagagtgacctgattttccagtgtcatctgtcatggcttcccttggctaggaaagggaattcctgaccctttgcacttcctgggtgaggcgatgcctcaccctgcttcagctcatgctcggtgggctacaccaactatcctgcatccactgtccaacaagccctagtaccagtacctcagttggaaatgcagaaatcacccatcttctgcatcactcatgctgggagctgtagactggagctgttcccattcagccatcttggaatcgccattccctttggcgtctttgtctctgctctgctttgcctgtatcattatggactatccctaggggagaatctggatgaacacaggtggtggctgagttctccacagcccacctgcagtgagtgaggacctgcctcttctcctgaatggtacctctttaaccatcagttgggcacatttgtctctcagcctggatcttctaaatgtgtccaagaagtcttagtgccagttgtttctccaggactgtgggaggctgtggcagctcaggggctgattgggagatcatctcttttccaacctttccctctatgagttccaacttccatgaagcctgtgtcttctcagaagagatgggagaggtttctttttctcatccagcccacagcctcagcaagggatcgcccatatcagtggctatcatgggcccaggcatgaggtgaccacaggagttggggctgcatgagacactcaccttgcagttggtggcaggtgtgtcctcaggggagtcctgtcagccagcactccaggtgcgggatgcagggcagggcagccttcaaggatagcagaagagtgggttgggttggagagggcaaggaggaatcacttatgtatgctccctagttttaaacctactaaaatgtttataggatagacctgaacagtctgatcatttcaaaaggtaaataaaactctccttacaatccttgtcctcaaagtccttagccccgcacacacaggattgtgcgcaatgagggaagctgcacctgccagcccaggcctgtggagttctgggcgttgcttcatcactttgtgtcactccataagggactgttcacgtgtatttgttcagcttcgctctccagaaggcccttcaactattagtccattgtatctctcaactctcccaacagattgttgaagcatttcacagaggaggaacccgaggctcctatgaaggaatagttcacccagagtcatggttgataggccacaggtcatggggatggcttgccttgggatgagtgtgtagattgactttaaatttctaaggaggggagtttagatatgtattcccaaaacttaccatcgccatctggaagtttgaattaccatcttactgggaactgtccaggtgacctcacactagagctcatgtgatatccgtttatgatgaggtggttgtgtgctcagggtgcacacatatctctgagtgggtgtgaggcacatgccaggtgggcacagagacatccacctggaatcccagaatggtttgaacccctctacatatagacctttccttggtgctgggaagtcaattgtcctctccgacccttgagagggaaggtcctgggtggcccataatgtttcagatgttttaggtatcagtaacctttaaggacattactgtggatgccacccaggaacagtgggccctgtgaggcccagcccagaggtgccatgctggagaacaatggtcccctgggcctagtgggtgagtctgtcagcactgattgatttattcatttatctttaataatttcaacttttcttttcgattcagggggtccttgtgcaggtttgttacatgggcatatcatgtgatgctgaggtttggggtacgattgatattgtcactaaagcaacgagtgcacatggtacacaacggttagtttttcaacccttccccccttcttctcttccttccccctcttgaattccccagtgtctattgttcctatctttatgcccatgtgtactcaacatttacctcccacttgtaagtgagaacatgcagtatttggttttctgttcctgagttaattcacttaggataatggcctccagctgcatccatgttgctgcaaagcacgtgatctcgttctttttatgactgtatggtattccatggtgtatatgtacacattttccgtagccagttcaccattgaagggcagctaggttggttccctgtctttgttatcgtgaataacgatgatttattttttgaacatgtgtccacgacagcttggccacacccctcctctcagccctcagtcacactggttctttcacagcacaaaggactacctgaaggaagcttgttaatgtctctacatctggcttgtcacccaccagagcatcatcttcccattgcaatgtcatgcctttctggctgctagatctccaatacccagaacactgtggctatctttaaaaaataaatcactagattaaatttttaccaagcaacaactctgttctgagcacgaagctagcgtttgagagcatagcaggaaaaataactggcccttgcctttttcttgcaaaactgagattgtgctggtggagctttcattgattggattattatgaaaataaaggtcagccagctgtggaatcttccttcactctgctctgagcctggccatgcaaaccagcaacatgagctcccactgcctggagatccgaggcaggactccctcctgtcctgtgagggacactggtgtcctcagggtcagggtgctcttccctggctgcccttggaagcccacctcattcttcctcaggagcctgccctgaacctgaggcccatgcttggttctggcataggattcaaatccctgcagcttcactgcagagcaggagctctgccagagagaatttcccaggtggagcaaggacagggctgtggagggcagggaaggtcctccctggggcctgagtccaggtgagccgcagacaggtgtgctcctgggaggacctagccagggagggagcagggtcttagtgagcgcggtgcggagttccaggaatggtgttttcaggtagtatgggggctgctggttgaccggttcctttgaggtcatattcctcatgcgtatcagtctcccttcctatatgttcctgtcctcctgggcgtcggagtttcccgttgcagcctctgccctgacccttgcccttggaccgtttccctcccctttcatccctgaaatcccagatctattctatttttcctcttatatcaaccctgaaaatgttgtctgtccgtttcctaagtcgtgtttccactcgctggtgtacggattgtcaggttctaccccatgcagctgggtgggcctctccggctccttcctgctcctgtaggtttcatcccccacctcccccaacagcggcttttagctgcctggggccgcccgcctgaccctaggacgagtgcggaatgaccccctctccacgcggagccctgagcgggaggcggcaggggcccaggcagcaggaactgggaacaagccgcccggcaggaagtttcgggtggctggaatttaggaagaagctagcctgagctcaaaacctcctgctaaacaaaccttaaggcgcgcatccggctctgtttcccacctgcaggttccgcattccttagcccagcaggcggggaggcgggagcggggtcagaattggtggaaggctggggttgcggggtgcagagagtgctgagccatgaagacttggggcagcgaggccgagtgatggcagagcctggggaggcgtccaggctgcgggggagcagggactttggagcaatgaccctggggggacactgagcacagggccagggtggcgtccaggggtctcgggtaggcctggactaaagaggcctgggaagagagacgtggggaggtcaaagggccctggtgagtctggatgaggagcagaggattgagtccccccagaactgagtccaatgtttttggggggagggacaaggaaacagtgagggggtgggggccatgtgccactgttcgagggacaaacccagctcagaggaaataaggcacgggggtgaggtgacaagggacatgggggtgacagggccatgagatgaggggtgtcgaggtcgggccaggaaaagatcaactaaacagccgggggaagtggggacccagggaagcaagacatggaggcatgagggagaaaaagggaggagggggagctcagcaaatcagtcactgccaggcgcctctaggagtctgattttgtggcaccttagtcatgttttcagagaagaggttcatagtctagaggatcccatggccacatggccaacacagggaggaagtggggtgaagagctggggtgcccatctgtggccccgcttccttgtgaggttcccacaggccctgtgggcacacagcccagctctgccctgaactcagggcctgcctgggtcctgtctcttccctcctgtactttctgtctcagctgagctgttcttgcctgcaccttagcacctcaggctgagtgggagggagaatcctaaactggccctcaagattctgccccctggggaacagccctgtgtatagaatccctttcaccagggtggcctggatctctgaatactttgggatctcactccccaagttacatgactttacattgcagttagggggttttgaagatgtaattacaacccctaatcagtctactgtaagttcatcaaaaaggagattttcctggagaggcctggtctaatcaggtgatccctttcaaagaagggctggaggctgggcatggtggctcacgcctgtaatcctagcactttgagaggccaaagcaggaggttcacttgagcccaggatcacttgaccccatctctacaaaaaatacaaaaattagacgggagtggtggttgtatgcctatagtcccagctacatgggaggctgacgtgggagaatcacctgagctcagggaggttgaggctgcagtgagctgtgattgcaccactgcactccagcgtgggcaacagagcaagaccctgtctcaaaaaaaataacaggaagaagaataaaaaagtgggctggaggtcagaagcagaagggatcagcgtgatgcaaggcagacagtctcctgcaggccctgaagaggccacctcctgtgctgtgctgctgtgccaccgctatgctgctctgccaccttgtggagggcctccaggaaggtttctgaagctgctgcgtgtgtggcaattggttacgtagcagcagaaaacaaatgcagctttctactcctccctctcctaccccacccctggatctaaccagttcctgatattctctaaccaaggatcaccctgcacactcctggacagccctggtgtgaaccctcactcaccctgggtggctgaagatggtttgggataataatgataatagtggctcctgatatctgttgggcactaactactgtgcaagtattttatgcccatgaagccatcccattttcacaacaactgcataaggaggcatatctagaagaggatctagcagccttccagttcaacttcatttagacatcaggatcccaggcccagaggcacaggtcatggtttccaagccccatagggcgctgttttcaactgttaggataatccagaacacctggagggcgctcctatgtgctatgagcaaagcaaaaacatccttcattcaacagactctccccaggctgagcctgcagaccccctcttgtgatagggtcagaattcagtttttaaagagcttagtgtgtagatactattgatgatctttgggagctgaagtgttcttgaactccaggcatagtaacatgttttaggttcatttatttgaagcattatgaaaggaaaatatatgttacacctcaaaaggagtttagattctctgtagttataactactgtatagtcacatgactattttctaaattttaagctaaatattcagtgtgataagatactcatttttgtacatgttatatccacttaactattaaagctggtcatttattacctcacatgcagtgttaagataatgagtaaattgttcataaattttcactactattattgggaagcatcatggcatgtaataaatcatcttttttatacatagaatgaaatcaaggctagggaaggtacatactactccattcgtgctgtgtggctaagaatggatctcatcgattgtgtataatggcaagatgagtactaaaaatatttgtaggatcaatacttgaatgttcataagcaagatgtcacaaatatcccaccattcctacaaattaaaataattttagtataatttttagacagcacatttataaacatgtgccaaatagaacatagccacctagcacagtgactggattggatgtagtacgtctctggattcctcctatgtgtttactggagatgtttgggaagtcacctagtcctttgattgttcatattctttatccatgtattagaatttcatagtaactgcttagctgatgtgtttcatgtaagttacagaattgtctattaaacatgctgtgctcattacctattataggatattgatttttgtctgtatatttgcccttctttaaaacattctagtacttttactttttagaacatgcaggagaatacgtagcaggaggagagcaaagatgacaccaacttttttcatttcttagcccttttgatctatgttatggatgaagatatagatgaaaattaaggctgagatatctgatatcctgatatctgttgggcacttttaatctgttgagaattttaattgttagatattttacttctgattatgtgaacatatacaatttaatgattaaaatattataaatttcatgcttaataataaatgtctttcatatatgactccatcaaatctttaaactttgcatatttatactgtgaaaaaaaatgaattaactaagcctccggctttctaaaatggaagcaggagaagcactcaaatctgctaaaggtcaagccacagaatgttccagtagacttggataaacaactgaagccaatgtccaccagccttcagcatctttcagctgggagtggcctcgttaactgaccaatcaaaacgagtttacaacttcggatttctgcccaacaaatcaactgcctttaaaaataacttttgtggaaatccttgattcaaaaatgtttcctgcacttgccttacaagacactcttcagggccgccctgactcactgtacctgagttgcaattctttgtttctcaaataaatgctatttcctttgacctccatgcccatcttttttagtgaacagcacagtatcgtaactgttattggtatccattattaagactgttggacctttcattgcttcatagaattatctttatcttgggcaagaaagtgaaaattatccatagtttctttaaaatagtaatattttaagccactcaaaataagaaaaagttaaagttcacaataaaaagatcctgatttacctgaataagacttgaaaagtgaagaacaattccttctacctgaaaagggtgttgacccagaatccaccttggacgaccctctagagctggcaagtcagcgtcatccccagtgcacctgtgactgacaacacatctcacccagctgccatagggatgtcaaagacacaggatacagtgctggaaagggaaaaagcatcagtgcaaaagtagatttcaggatttggagcacggaggcaagtgccctctcctggcatccctgcatggggccatagtgaggaggctctgcagtcttccaggaggactggaccatggataggaaatacccaagacatggattctctagggacatgggcgattccaaaagcaccgaggagcgtgcccctagagaagcagtccactgggtccgtagtaaaatctcatggcataaccaatgtggagaccagagactaaaaatctgtaacgtccttggtgtccatggacctcaaagccaaacacaacagccccacgagtatctgtcatccaggcacggagagctaggggcgagcttctaagggtaaaggaggcttcttccctgtccagatgtgtggacgcttgggtttacagataatggaggtgtctatgtatgttgtcatgaaaatataaggcaagtggcaccaaatatgatttagtggtcccagaaattcggtgctgtgtgctttctgcacgacattaattttaattatatggacacagaaggagaaaatttaaaacttaaatgtcttatcattgctagaaaaataaaagttttttccctacgagttagaagtcttgatctctgcgtttttctatggatcgattctcaaagtttgtgcaaatacagttggtgtttctttctaagtgtctttggttatgaactaaggatgtaaccaactcctgcttattaggtaaagggatgaggcaagagagatccagcaacagggtgtgtttttttttcaatctttggcaacatttttctgtgatgtccaaagtagtgaactccctgactagggtttcagacatggagtgttctaatccaccaaacaccaaagggctgggaagaagtgatttggacatggataaccagtgtcacctacaacatggaacagagggtcatcaaagtggtctgagtcactttaatatgtggctggagagatgcaagaacaacagaaagagccctcaggaggcatccccacccaagggcagtgaagctcagtgcagctgcggggtgtggggtcatagggtgaccaggtgacagggctgatggggaggagaaatgctctgttaagggtgttgtctctgtcacttcttcaaaaagcagcacagtctcaggcacatgctccctcctgccccaccccacccacaattgatccactgcagctcttccaagatgcttccctccattctagtacctccccttactcctgagcccctgtggcctctatcttactccctctctccagttctttgtaccttcctcctctccctcactcacctcccctcccatgcaaagcccctactggttcccccctccccacttcacctccactcacactccatcttcaccctccattccagtccttcccttcctctcctcactctgactccaccggtgaactcacttcccatcccttctgtccatgtccctgcctcagtttacctcccttcccctctcctcaccttccttggatgcacctgacctctcctgcctccctccccttcattcatgcccttcctttcttctctctccagttccatctcctccaacatgctcccctccccctttccttcagcctctgttgacctctccaccctcccacagtcccctgcactctcctgccaaggacatccctcccagccatccccgccctcctcacctcacctcgtttggctccatgtccctcagctccccttccctccctcttccctgtcccaagagccatctgggtttcctttccagtctccctctgcttgtgtgctttcttccccttccctgacttcccctgctctatcttctcctcagttccccgccctccctctctgcacctgcccagtttcccccatctcccctccatgctccctttctcagtttccctccccagctcctgagttggaccacctcagctcagcgccctacttcctgtgcctgcccctgcctgctgcccaccctccctgcacacagctcacttctccctctggccctcctgctgagcaagtggctccccgactgccctgggcctgcccactttccccagcccccgcagtcaaggctctccacatcaccggggtgagggccgagatgcaccctctccagggctctgcttcctccagcaggtcccagatcctccctccaagctaagctccatggcccatccctcccctgggggcaacaccacagggaccttttgcccaccttgccaggcttttcagaggcctcgaagctgtggtcaggcaggcaagtggggagcaagccaggagttacagatccagagcttggggcagtccaggcagcgggggctgtggtcccctgtgaccacttctgtgaccttgccacttgaaccctccagggcctatgtcctcacctccaacgtgaagatcaggctgggccattattgcaaagctgtgctgagtgttgacaaaggtgcatgtcacgctttattacaggtagctggtgtttcctgagcatttggaaacaacgccctgtaaaatactgtgaactaatcgcagagctgggcacagcatgcttcatgatcttattttatactgacgtgttttgtcatcgtgctgtcaagtattctccagccacatcatttgttagtagtttgacctgcataggagggcagtgtcaccctccttcctgctgtgctgatttcagcgagggcctccgggccagactgccccgtgcgccccctgttgactaacctgggaatcgcccgccgcctgccttgagccttgtgatgtgggcaggacggggccggggcagggccaggagcctgcggggaggcgcggggccaggcgcctgcaggagtggaacctgcccaagatctaggagtagctcggtgcaggaccaggacagagttcacacccctggcttcacgtacacgtattttttttttttatactttaagttctagggtacatgtgcacaacgcgcaggtttgttacataggtatacatgtgccatgttggcttgttgcacccatcaacccgttatttacattaggtatttctcctaatgctatccctcccccagccccccatctccctgacaggccctggtgtgtgatgttccctaccctgtgtccaagtgttctcattgttcaattcccacttatgagtgagaacatgcagtgtttggttttctgtccttgtgatagtttccagcttcatccatgtccctgcaaaggacatgaattcatccttttttatggctgcatagtattccatggagtatatgtgccacattttcttaatccagtctatcattgatggacatttgggttggttccaagtcttttctattgtgaatagtgctgcaataaacatacagacctacacataaattaaccggtgtgtgtcaggtgtagataccagccaagaagaaaagacaaagtcagcgggggcagctctaggacagcgatgacctgggtcgcttcattctgtgcctggggaagaaccaaagccacttggagattaacgccatgacaaaaacaagggatgacgtgtgtgcagttgtgggtttcatgtttactttccacgactctagaggacttgcccacctgttcatacataaaccagtgcccagggccccactgcccggtgagggctccatctcccctatcaccccaccccctgcttagctcctggcccgccccaaccatcccttagttgatgagttggtgaagctgccccctttttcctccctataccttctcttctctcccccaggtcctgctgggccacagtcttcggtctctctgccccacctgccgaaggacccccctggtctcttgggtcctcacctgcatgctcccgagctcacctctaagttgtgtctgcccttcacaaggctggccccctgcagcccaccccctcacctggggcaccagggccatccacttcctccactctcctcacactcccgaagtgactcagggctcccctgagcagctgggctggagtcctcccaccaactccctcagttatacctgctcccgtcccctcagacccagccccccaggtctccagacccattcatggacgtggcctcctaggcctctcaacactcacctcccagcaacccctcagccctgccctccccaggcaccaacttgggacccccacagaggcagagacacctattcccacttgggctcatgtcaccctggctcactggggatgctgagcctgtgagcccaatcttgctccatccctccagttcctttctccaatccaagttctctcagacctgtggtgtcactcccagaagccatctggacacccaaggcactgcctgacggagatggccatgctcttccctgtagggatggacaagggacacctgcagtgcacaggtcacagtctcaacctttggaatggtgtggcaggctgtgccctagtagggcccccaccagggcccctgaatggctgctccccatcagtaacaaggaagacccttgatgatcatccccactgcctctgagatgggcccggaaaggcgtgagcttctcaagcacctgggtcaccatctgggaaatggcagtcatgatcaagtcaatcccttgtgccccagagacactgtaactccccagtagaatcccacagggattgaggccaccctaggcaacatagcaaggttccatctctacaaaaaataaaaacatagccaggagtggtggcacacacctgtagtcccagctattcgggaggctgaggcgggtggatcacttgaggccaggagttcgaggctgcagtgagtagtcattttgctactgcactccagcctgagtgacagaaggggaggagagggagaggggaagggagggaggagtgaggggagggagggagaggaggggagaggaggggagggagagagagaaggagaggagggaaggggagggcaggggagggagagagagaaggagaggaggggaggaagaagaggagaaagaaggaagaaggaagaagaagaattccagagagtgaagagccaccaagggtatccccacactctgtgcaagcgtctatctgcctgaaacatacatgtgtgaaactcactgttggcagcacaatcaagacggaaaattagacctgagagcagcctctgtggtctttgagagggacccaggggatgaccagaggcagggaggctccatgggagggagaaacacaagtagatggccttctctgtggcttccagcctggggcaaagggtggtcagtctcgagatgcccagtaggggaaaggctcgtgtgggaaaagggaaatcaaaaatcctgccacctgcacagcacaggggaatcacccaaggctccaaagggtcattactgtgatgtctgtagcataacatccacatcgctgtaacatccacaggggcctccttaacaccatcaggctctggaatcggagagcagaagcttcacagctgtagctgaagtgggtctgagtacagactaatctctatcgtgcagcttactattatccctcctttagggacatggtcattttaaaatattttattttgaaataattatagaacttatagaaaactgcaatagcagcataatgggtgcctgctcccttcacccagctcccccagggcttctagttttgccatgtgtccccacctcgctgaccagccccagtagacggcaccaaaggcaggcaggatcacacactcctctttgctcaaaacactcagggatccttcctgccccacacaccctctccatgcacccacattctctgcccaagggtggcctggcccccaggcccagctcatccccagcatgtgactcctttcactcaggctgtggatctcatgtattgcaaatgtggtttaaactttgagaacagcaattctggtttgtagaaaaaaagtgaggatctaggcgtttgcagtcatgcacatgttcgtattttaaatacaggccaatgagctgctgcctagtgtgcctaccagagacacacctgttgttaaactacaactggatttactgttccattctgcaaaaatacgccatggtgctgtggagggtgcagtgagaggcttggaagagccttgccacaggctgtgtgtgtgtgccagctggccatgggtggactaactggagaggggctggctctgagttgagcactgttaggaagcaggaggaggtaggtatacactggaatcttcataaacctcatccccggggaggcctgacacgggcaggacaggctatcaccaaggccaaagcggcagtcatcatgtgggctgggagaggacacggctggcactcctggcctgagagatgctcccatctgtctgtattcagacaggattctggagtggcttgtctttgtcttgatcagaccatctggggtcttgcctgctgctggtgtcctgagggacagtttgtgttctccaggagagccccacaacctcactgagggtgccagcccagctcctgggacacagccaccctcctccttctcaagctttaatgagaaacgggcaggaggttgccggagaaccactgcccatcttccggggtgctaggggtgtctgctggcagttgtggtctagggcaaaaagagaagggaagggaaaatctttcagaaaataacggaatcacaatggggctgcaggcgagatgagcaaactgggctggtggcatccagggcgttagcaaagaaaaaagcaccagtgttcaggcagccagggagcccagccgctctcttagggtcaccccctcccagccctccggaggccacccttgtcccgccctgccccaagggcacagcccgcgcccctcccccagtcctctccctgctgggctgccccctcccgcggccgcatccctagtcagtccctgagaccgtccagagttcagtccccgggatcaggcttgcagtgttgggccgccctccttgccagatgccgccctggagagggcaagggcgcagaaagggctgagcgtcccgggtccctgcgtggccgaacggcatgtgagcacattccaggaataaggaaacgagaggagtaggcatttctaccgtctaaggcactttgcatgaaatcccgtggcactggaaaagtagttcaaacaaagtaacgctggcttttacgatgcagataaacggataagcggcgtaggactcaagtaggagggctccgtgcacaccaggcgcagcccagcggggatttgcctgcgcgtcccagcgcacagggaggtcgctgagtcccagggaagccccctgggctcgcgctgcaaactcaggcagcctctgctcctgccctacggctttgagggcacgtgctcctccggggaggcacagcttcctctaatttcccacttcctcatccggcccttaattcactaaagactaacagggaatgatgttcattaccaaagtaggtgctccccctagtgtagcacagaacgcggcgctgttctcactattgaattggaataatatttttagtatcaaaattaattctagaaatctattacagttcattttccagaaaacaagggtagcaaaaatagtataggtttgtttcttaatttctttatgacacacatcactggttcatgtgataacgtgtggattctcacctggaagacacaagaggaataaaatcaccatattttaaactctatctcaagtctctcaacatttcaggctgtgctcatttacacactacagaatgatgagtattcagtggaaacttttgcagaacaattaaaattgcaaaatcggagccgggcgcggtggctcacgcctgtattcccagcagcactttgggaggccgaggtgggagtatcgcttgagcccgggaattcaagaccagcctgggcaatatagtgagccatcatctctaaaaaaaaaaaaaagaaaaagaaaaaattgcaaaattacctaaaatgaaatgcatacattgaaacgcccacaattattatgaaaattaaagttaatattaacaacatatgacatgagccacaagatttacattaaaatagtctagttgacaataacttgaatatttaaataaagtcctctttatctctaaataatatatttacagtctgccattatatgaatcacttaaaattcagatgaggatattaatcaatattgacaatttcttcaggaatatcaagtgaataataatgatttcacttttttgtttcattttgtttttgacataagatcttgttctgctgcccaggctggagtacagcagcaggatcgtgactcactacagcctctgccttctgggctaaagcagtcctcctacttcagcctcctgtgtaactgggaccacagatgcacaccaccaggcccaggtaattttttattttttggtagagacagagtcttattatgtttcccaagctagtcttgaacttctgggctcaagcaagcctctcacttcagccacccaaaatgctgggatgacaggcatgagtcaccatgcccagcataaagattttattatgtggaaataaaaggacattaaaatataacttgaaataacccatttctcgcaagtatttatttttccaccagttaatcaaatagtgccaacactagacaccaaccccacttccattgctaatcccactaatacactcaccaagacttcaattcctgacccccatgtctcaggatactcctcaatagccattgccatagtatatccaaaaacaaccatcgtaccccctagataaattaaaaaaaaccattaaacccatataacctcccccataattcagaataataacacacccaactacaccactaataatcaatactatacccccataaataggagaaggtttagaagaaaaccctacaaaccctattactaaagccacacttaatgataataaagcatatgtgattaatcccacatggattacaaccacgaccaatgatatgagaaaccatcattttatttcgactataagaacaccaatgaccccaacatgtaaaactaatccactagtaaaaataatcaaccactcacttatcgatctccccgccccatccaacatctccatatgatggaacttcagcttgcttcttggtgcctgcttaacccttcaaattattacaggactattcctagctatacgctactcaccagacgcctcaaccgccttctcctcagtcgtccacatcactcgagatgtaaactatggctgaatcatccgctacctccatgccaatggcgcctcaatatttttcatctgcctcttcctacatattggccgaggcctgtactatggcttatttctctacctagaaacctgaaacattggcatcattctcctactcacaaccatagcaacagccttcataggctaggtactcccatgaggccagatatccttgaggggccacggtaatcacaaatctactgtccgccattccttatgtcggaacagacctggtgcagtgggtttgaggtggttattcagtagacacacccactctcacacgattcttcaccttccactttatcctacctttcattattacagccctagtagtcttacacctactatttctccatgagacagcatcaaataacccctcaggaatctcctcccactccaacaaaattaccttccacccctactacatgaccaaagatatcctaggcctatttctcctccttctcaccctaataacactagtactgttttcacccgacctcctaactgatccagataactacaccctagccaaccgcctgaatactccaccccatattaaacccgaatggtattttctatctgcctacgcaatcttatgatccatccccaacaaactaggaggcgtactggccctcctactatcaatcctcatcctagcagcaattcccacacttcacatgtccaaacaacaaagcataatattctgtccactaaaccaattcctatattgactcctaattacagatctccttatcctcacatgggttggaggacaaccagcaagctaccccttcatcaccttcggacaaacagcattcgtagtttactttgctacaattctagccctgataccgcttgcctccctactcgaaaacaaaatactcaaatggacctgcccttgtagtataaaccaatatattggtcttgtaaaccagaaatggagactctctcccaaggacaactcagagaaaaagtacttgacttcaccatcagcacccaaagctaagattctaatttaaactactctctgtattctcatgagggagccattttgggtacaacccaagtatcgacccaccccaccataattttatatatatcgtgaatttctgctagccaccatgaatattatatagtactataattgcttaactgtacatagtacatatcaaacgaaactcaacaacaactcctccccacgacgcttacaagcaaggactagaataccttaactaacggtaacacattaaacccaccctccaaaagaaacttctcaaccacaagcgtaccaaaaaacactatatatccttgagtacatagtacatctaatcgctcatggtagatagcacattccagttaaacaagtcctcgtcaatacggatatccccctcagatagtggtccgttgttcaccatcctctgtgaaatcaatatcctgcagaagagtgctactcttcttgatccaggtccataatacttgggggtagctataatgaactgtatccggcatcttgttcttacctcacagccataaagtcaagaccaaccacacgttccccttaaataagacatcacgatggatcacgggtctattaccctattaatcagtcacgggagctctccatgcatttggtattttaatctggggggtgtgcacgcgatagcattgtgaaacgctggccccagagcaccctatgtcgcagtgtctgtctttgattcctgccccatcccattattgatcacacctacattcaatatcccaggcgagcatacctatcacaaggtgttaattaattaatgcttgtaggacataacaatcagtaaacacacccacggccgcttttcacatcaactctacaataaaattctgcaaatccccttcccccatctttggcctcaccaacccaggaaaagacatctttgccaaaccccaaaaacaaaaagccttaatccaactcaaccagagcccaaatttttatctttaggctgtacgcatttttaacagtcacccctcaactaacacgtctttttccctcttagcctcacttcacagactctacaaatttagttatccctttttcagccatcccattcaacgcatgcccgaccactactaaaccaacaccctaaactaacccaaccccaaaggcaaggctttcccccctacccattgcttgtatgcccatcccctagccttgcttacactgtgcaatcacagtctatgtagcttaatgacccaaagcaagacactgaaaatatctagatgggcctacactgccccatagacaaataggtttggtcctagcctttctattaactcttagtaagattacacaagcaagcatcgccaccctggtgaaataaccctctaaatcactacaatcaaaaggagtaagtatcaagcacgcattagtgcagctcaaaacactttgcctagccacacccccacgggagacagcagtgataaacctttagcaataaacgaaagtttaactgagctatactaactttagggttggttaatttcatgccagccaccacggtcatacgatgaacccaagctaatagagactggcgtaaagaatgttttacattatccctcaataaagctaaatttcacctaagttgtagaaaaccctagttgatataaaacaaactacgaaagtggctttaatatttctgaatacacaatagcgaagattcaaactgggattagataccccactatgctcagccctaaacttcaacagttaaatcaacaaaactgctcgccagaacactaggagcaacagcttaaaactcaaaggacctggcggtgcttcacatccctctagaggagcctgttctataatcgataaaccccaattcacctcaccacctcttgctcaacccatataccgccatcttcagcaaaccctgacaaaggccacaaagtaagcacaagtatctacataaaaatgttaggtcaaggtgtagcctatgaggtggcaagaaatgggctacattttctaccccagaaaattctacaataacccttatgaaacctgagggtccaaggaggatttagtagtaaattaagaacagagtgcttaattgaatagggccataaagcacgcacacaccacccatcaccctcctcaagtatatttcaaggactatctaactaaaacccctatgcatttatatagaggagataagttggataaaccaaggtgtagcttaacataaagcaccctgcttacacctgggagatttcaatttaatttgaccaccctgagctaattctagccccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaagatggcagaccccagcaattgcataaaatttaaaactttacaaccagaggttcaacccctcttcttaacaacatgtccataactaaccttctacttcttattgtacctatcctaatcgccatggcattcctcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaaacttaagaaatatgtctgacaaaagagtgactttgatagagtaaataatagaggtttgaatcctcttatttctaggaccataggaattgaacctatccctgagaatccaaaattctccgtgccacgtgtcacaccctatcctggagtaaggtcagctaaataagctatcaggcccatacccagaaaatgttggttatatccttcccgtactaatcaatccactggcccaacctgtcatctactccaccgttttcacaggtacactcattgcaacattaagcttgcactgattttttacctggacaggattgaaaataaacatactagcttttatcccaattttaattaaaaaaataaacccccgctctacagaaactgctatcaaatactttctcacataagcaaccacatctataatcctcataatagctatcctctccaacaatgtactctccggacaatgaaccacaaccaacaccaccaacaaatactcatcattaataatcacaacagccctagtaataaaactaggaatagcccctttccgtttctgagtcccagaagtcactcaaggaacccctctaatatccagcctacttcccctcacatgacaaaaattagcccctatttcaattatatatcaaatctccccattaataaacattctccttaccctttcaatcttatccattatagtgggtagctggggtggactgaaccaaacccaactatgtaaaatcctagcatactcctcaatcacccatataggctgaataatagcagtactagcatacaacccaagtatcaccattttcaacctaatcatctatatcattctaacaaccaccacattcctggtactcaacttgaactctagcactacaaccctactactgtgccgcacttgaaataaactaacctgactaatacccctaatcccatctaccctactatcactaggaggccttcccccactaactggctttctacccaaatgatttatcattgaagaattcacaaaaaataacaacctcattatccccactaccatagccattattactctctttaacctatatttttacatacgcttaatctactctgcttcaattacactattccccatatccaacaacgtaaaaataaaatgacaatttgaaaatacaaaatccacaccactcttccccacactcactgtccttaccaccctcctcctaccaatctctccacttacactacccacctcatataaatttatgttaaacgcagactaagagccttcaaagcccttagtaagttaataatacttaatttctgcagcacccaaggactgcaaaaccctactttgcatctactgaacgcaaatcagccactttaattaagctaagcccttgctagatcaatgggacttaaacccacaaaaatttggttaacagctaaataccttaatcaactggcttcaatctacttctcccgccgcaagggaaaaaaggcgggagaagcccaggcaggattgaagctgcttctttgaatttgcaattcaacatgaaaggcacctcagggctggtaaaaagagagtttttagatttacagtctaatgctttgctcagccatcttacccactaatgttcgccaaccgctgactattctcaacaaatcataaagatatcggaacactatatttattgtttggtgcatgagctggagtcttgggcacagccttaagcctccttattcagactgaactaggtcaacctggcaaccttctaggtaacgaccacatctacaacgtcatcgtcacagcccacacattcttcataatctttttcatagtaatgtctatcataattggaggttttggcaattgactggtccccctgataattggcgcccctgacatggcatttccctgcgtaaataacataagcttctggctccttccccacccctttctactactgctggcatctgctatgatagaagctggtgccggaacaggttgaacggtttaccctcctttggcaggaaactattcccatccagaggcctctgtagacctaaccattttctcccttcatctagcaggtgtctcctctattctaggagctattaatttcatcaccacaattattaacataaaaccccctgccatatatcaataccaaacgcccctctttgtctgatctgtcctaatcacggcagtcctactcctcctctcccttccagtcttggccgctggcattactatactgctaacagaccgtaaccttaatattacctttttgacctggccggaggaggggaccctatcctataacaacacctattttgattctttggtcaccctgaagtctatattctcatcctaccaggctttggaataatttctcacatcgtaccatattattccggaaagaaagaaccattcgggtacataggtatggtctgggctataatatcaattggcttcctagggtttattgtatgagcccatcatatattcacagtagggatagatgtagacacacgagtttactttacctctgtcactataattattgccatccccactggcgtcaaagtatttagctgacttgctacgctccatgggggtaacaccaaatggtccaccgcagtactctgagccctaggattcatcttcctttttacagtgggtggcctaacggacattgtactagcaaactcatcattagacatcgtactacatgatacatattatgttgtggcccactttcactacgttctatcaataggagctgtgttcaccatcatggggggcttcatccactgatttcccttattctcaggctacacactcggccaagcttatgccaaaattcactttgccatcatatttgtaggcgtaaatctaaccttcttcccgcagcactttctcggcctatctgagatgtcccgatgttattccgactaccccgatgcatataccacaggaaatattttatcatctgtaggctcattcatctccctaaaagcagtagtgctaataattttcataacctgagagaccttcgcttcaaagcgaaaagtcctaataaatgagcaaccttccactaacctagagtggctgtagggatgccctccaccctaccatacatttaaagaaccagtctacataaaacctagacaaaaaaggaaggaattgaacctcctaaggctggtttcaagccagcctcataacccctatgactttttcaacaagatattaggaaaactatttcataacttcgtcaaagttaagttacaggttaaaccccgtatatcttaatggcacacgcagcccagctaggtcttcaagacgccacatcccctatcatagaagagctaatcgccttccatgatcacgccctcataatcatctttcttatcagctttctagttttatacgccctcttcctaacaattacaacaaaactaacactaacatcacagacgcccaagaaatagaaactgtttgaatgattctacctgccattatcctagtcctaattgcccttccatccctacgtatcctgtacgtaacagatgaaatcaatgacccttcttttaccattaaatcaatcggacaccaatgatactgaacctatgaatacaccaattatggaggattaattttcaactcttatatacttccaccactattcttagacccaagtgaccttcgacttcttaaagttgataatcgagtagtccttccaattgaagcccctgttcatataataattacatcacaagacgtcctacactcatgaactgtccccacattaggcttaaaaacagatgtaatccccggacgcctaaaccaaaccacattcaccgccatacgaccaggagtatactacggtcaatgctcagaaatctgcggagctgaccatagcttcataaccatcattctagaactaatcccgctaaaaatctttgcaataggacctgtatccactttataggctaccgcccactctcttaataaggttcactgtagagctgacccagcattaaccttttaagttaaagactaagagaatcgctatctctttacagtgacatgcctcaactagacaccaccatatgacccactatcgtcgcatcaatactcctcacattattactcatcattcaactaaaagtactaaacacaaactaccatctgcctacctcactaaaaattattaacatgcaaaaccacaataatcctttagagtcaaaatgaacgaaaatctgtttacttcattcattgcccccacaattctaggccttccagctgcagtgccaatcgttctatttctccccatgctgattccagcttccaaacaccttatcaacaaccgattaattaccactcaacagtgactaattcaactcaccctaaaacaaataataacaataaataacattaaaggacgaacctgatccctcatgctaatatccctaattatcttcattgctacaaccaatctcctcgggctcttgccccactcattcacaccaactacccaactgtcataaacctggccatggcaatccccctatgagcaggtgcagtaattacaggcttccgctttaaaaccaaaaataccttagcccatctcttgccacaaggcacaccctcacccctcattcccatactaattattatccaaaccatcagcctatttatccaaccaatagccctagccatgcccctaactgctaatattatggcaggccatctgctcatacacttaatcagaagcgccacactagcgctatcaactatcaacctccccacaacctcaatcatcttcacaattttgattttactgacgattctcgaaatcgctgtcgccctgattctagcctatgttttcacactcctagtgagcctctacctacatgacaatacataatggctcaccaatcacatgcctatcacatagtaaaacccagcccatgacctctaacaggggccctttcagccctcctaatgacatccggcctagctatatgattccacttttactctaccaccctactaacactaggcctactgaccaatgcactaaccatataccagtgatgatgtgatgttgtacgagaaggtacataccaagaccaccacacagtacccgtccaaaaagtccttcggtatggaataattttattcatcatctcagaagtctttttcttcgctggattcttctgagcattctaccactccagcctagcccccacccctcaactaggaggacactgacccccaacaggcatcactccactcaaccccctagaagtcccactcctaaacacatctgtactactcgcatcgggagtttcaattacttgagctcaccatagcctaatagagaacaattgtaatcaagcaattcaagcactacttatcacaatcttactaggcatctacttcaccctcctacaagtttcagaatactttgaagccccctttactatcgccgatggtatgtatggttcaacatgttttgtagctacgggcttccacgggctccccgtcatcattggttcaacattccttactgtttgccttatccgccaactattatatcattttacatccaagtaccacttcggcttcgaagccgctgcttgatactgacactttgtagatgtagtttgactattcctatatgtctctatctactggtgaggatcttactcttttagtatagacagtaccactgacttccaattaactagtttcgataacactcgaaaaagagtaataaacctggcactagccctaacagtcaacaccctcctggccccattactaataaccatcacattttgattaccacaacttaatatctacataggaaagtctaacccttatgaatggggtttgacccactatcctctgctcgcattcccttctccataaaattcttcttgattgctatcacctttttattatctgacctagaaattgccctattactacccctaccgtgagccctccaaacaaccaatctaccactaacagttgtatcatcactcacattagttactatcttaatcctaagtttgacttatgaactatcccagaaaaggttagactgagtcaaattggtaagtagtttaacagacaaaaacaatgattttgacttgttagattatgatagtcatacttacaaaatgcccctcatctacataaacattacattagcatttactacctcactgttaggaatactaatctatcgctcacacctaacgtcctccctactatgcctagaggggataatattatctctattcatcgtaaacaccctcataaccctaaacacacactctcccttaattaacatcatacctatcaccatattagtctttgctgcctgtgaagcagcagtgggcctcaccctactagtctcaatttctaacagatacggtctagattatgtacataacttaaacttactccaatgttaaaattaattatccctacaatcatactacttccaacaacatgactctctaaaaaccatataatttgaattaacataaccactcacagcctaattaacagctctatcccactgttatttttcaaccaagccaacgacaatctatttagctactctctttctcctctgaccccctgatgacaccccttctaatactaacagcctgacttctacctcttatgatcatagcgagtcaatgccacttatctaacaagtgccccttacggaaaaaaactttacctgtctgtactaatcacccttcaaatctccctgatcataacattcatggccacagaactaatcatattgattattagtggtgtagttgggtgtgttattattctgaattatgggggaggttatatgggtttaatagttttttaaatttatctaggagtatgatggttgtttttggatatactacagcaatggctattgaggagtatcctgagacacgggggtcaggaattgaagtcttggtgagtgtattagcgggattatcaatggaagtggggttggtcttatgagtgaaggagtatgatggggtggtggtagtggtcacattctttgctgaacaaacggtacctcaaataacttcatacaaatactactgggaaacttagcattttattaaaatgtttaaatttcctattttatcaaatctaacatattagtaataatatattccttttattcaactttaaagttctattcaacaatagcaatttataattttatattattaaatgttattcatacagtttaataattttataatttagcattaatgaaaccagcacagacaatataatgttcatgatattttatgtatatgtttaacatacacatacataattcaacattaatggcttccttaattaccattaatattataattttatattatcatttaagtttgcccttctattttaatattagatgtcttagcatccatcagttctatcaagctcttctcactggttcttctttgaattccagacatggccacaatcttctcttctaaaattctaaaatctgagggctctcgctggctgggtgctgctggaagaactgtaacttggttgttatctcaacggtattttattttaaatgtttcaattaaaagaagtttttaaaaatgtggaaatccctgagaatattcacttttttaaatacaatgggaatgtatttaatgtatggctgaagtctgtttctcctcgtttgatccaggggtgcttctgagaactcttccaagtgccagatcctgggccgctggcagcttggccccagtggcagttcagttaccccatcacggctggggcaccaggggagccccacaggtgggcgaaaattaccgtagattaaaacctaggcagtttaacacaagcagccagcaccaacatcacggtacttgatcttccaacttcctgcactaccaattctatgtctcatcacattctcctctggcctctcggcccccagcacacaggcttcagcctctgtttctgctgaagccctttcttcatacactctagaacatagaacataggacagagagagagactttagtaggaatactgacatttaaaaacttatcagagatatgaaaaatcaactacatgaagtacggcggtatattaaggctttgtgaataaaaacacagtaaagggtgggtgtgtaaagctattttccaaccatccttccaaaccaaggcttttgagggcacaagtcctcccagcaggtggcaggatgggcccagcagtgtcttcagcccattgctgtcatgagttaggaaaggctgaattctattttacatacaaaagaaaacatttatttaattaaagattcaagctacaatacagttcttcataaaacactacaatattttgattatcaatgtttttctgttgctttttctcatgaaacatgatttgcctttgtgaaatctgaagtttcctattctatcaatgagaaggtgtatcaaatggatagtccatccagtgtatccgacatcaattacaaaatgcctccctttttcttaattttgccttttttccctttgtcattcttgagtctctgttagtgcactgaggaagtgaagacatgtacttaaagaaatgccaacatctgctgaagatcagattccgtattttgtattttagttgatgtaatgatgactttagttataatgactttagttgatgtaatgattctaatgaacaagaaagattttgtttcccattttaaaagatatcattaagtcatgcagaatatttttcaatttattatgggtgtgtatgcaaggggttgccatttcacctgcttcagtcttccctctaaaccaatcctaagacacacctaggctgaattcatatcacatgaaaattcatcacatgatgtcctactaggtcaaaaagtataaaaactgacattacggagaaagacttcattgaaaccaggacagaaagacactaaggcacacagtgctcagagcggcatgctgacaagatctctggtgggaggccattgcctggacacctgctgggttttgtcctggacaccattcattcacttgagcatgtttggtacccagggtatttttcaataataggcaaaatagaatgagttcttcaaaccttgtggattttatactgaaaacttccagagatatatcttaggtaattataagaccaagcacaacaacaacaacaaaatcctaacttgaatccatcagttgcagatttcatggttgactacatcaagaggaagttgcaagctctaaaagctggaagaccagtcaatatcaggaactcctcagaagtgaaggaaaagtggtttaaatttgtttaacaaaaccatgttttcaaacttactttaatttatgcatgagggccattaaatttgttctttttaaaaaggaaacttcttaattggaactaaatcattcattattcactgtgatacgggttatatacccttaggttccatgtgattattcacatgttcagctgacagaaaggagaaaaagctactctaatgacttagcttcgctttgactcactggtttttatctcattttaacttccaatctcggttacagagagtgttaaagctggaagaaataacattttggtagatggtaaaggataagtacgagtcatttcaagttgttgaagctttcattaaacaaagcaagctatttgaaatcttaaagctatttaaataaagggctaagacttttccgttttatttacttaaaagcttaaaagatactgttgaaaatttaacagttaatctattgtagggtgtggttagacacttattttgacagtgctcactgaaaattcaattatacccccggagtcaaacttgccagtcatcaaaatgtctaacgatctgagtgttcacggggtaataacaaaccccatactaaacagtttgctagaaatctgtcctataacatctaaacggaacaattgggtggttgtctaagacacctaagctcaatatgacatttcagctaaaaagagtgaacttataactaagcacttcatgcaagttaccaaaagagaagatattctttaataaaaaagtacatttgtagaatcaaagaatctcagtgttgtaagaaatatttgagatcatttcagttaggcttttcatttcttaaatttgaaactgaagctgagattaaacagctaataaaaagacaaagccgatccatgatattggtttgggcaatgatttcttagatatgaccaaaacgcacatacaacaaatgagattacatcaaactaaagagcttctatacagcaaagaaaacaattaacagagtgaagagtgacaactcacagactgagaaaaaatatttgcaaatcatatgtttgataaagagctaatacacaaaacatacaacgaattcaactcaataacaataaaacaaccttgttaaaaaatgggcaaaagacctggacagatatttctccaaagaagacatacaaatggccagaagagatattaaaaggtgttcaatatcaccattgattagggaaatgcaaattaaaatgagatttcaccttactcattttagaatggctattacaaaaaaaatgaaagacaagtgttggtgaggatttgaagaaaagagaacacttgtaaaatgttggtgggaatgtaaattagtgctgccactatggaaaacagaagggacgtttctcaaaaataaaaatacataattactatatgacccagaaattctacttctgggtgtatattcaaacgagttaaaatcagtatgttgactagatatcaacacttccatgttcattgcagcattattcacaatagccaagatatggaagcaatctaagcgcatatcaagggatgaatggataaagaaaattatatacacatatttatagtgtatacacacaatggaatactattcagcctttaaaaaggatacaattctgtcatttgtgaaaacaaagaaaaatctagaggatcttacataaagtgaaatcagtcaggtacagaaagacaaatacatcatgatctcacttacatgtgaaaagtaaaaaatgtcagactcatagaagtaaagagtagaatgatggttaccagaggctggaggaggcaggatagacagaaaaaagaagattaatttgttaaatggtacaaggttcagctagatagaagaaataagtcctagtgatctattgagcaatagggtaattatagttaataataatgtattatatatttcaaaattgtggagtatattttaagcactctcaccataaagtagtgataaatacgtgagttgaaagatatgttaattcacctgatgtaaatgttccacaatgtatacatgtatctaatcatcatattgtatgccataaatacatacaatacttaattatcaaataaaaagttaagatggagctgagccaagaatccaagtctctgaatttagatttttcattttctattatgccaaagtgttttctgaaaattaaaattgaatatggcatgtccaaaagaatatgtcataagaagacaggaatggggggactgctgcatataatctcatatttttagtcagttttgtaacatattattaggagaagaaaatcaaatattttaagaaaatttttataactcctgtaatactgtaattttatggcaaacctaaaaccttcaaaacacagagtttttttaaaaaagtgaatcatatatatgcaaagtttttattgagattattaaagcaaaatccctcaaagtagcaaaacataagtatatgttttagactgtactatgcagaatagcagaatggtaccaatggcaaaaaatctttcaaaagacataaaaattattgaggtctcatcccagctctactaatctatgtcttagcaacctagtgtaattcctacaagttctgaacactgcctttaatgtatctgcatggttcccatatcattttataaacttcaaatattcacactttataattgaaacaatatacaaactttattattaaataagctatgggatgatattctccatctaccctataaggatactatcttcctgtcagaaaatctgagactctccaatacatatttactccccagatcttttctttttcttttttttttttttttttgagacggagtctctctctgtcgcccaggctggagtgcagtggcacaatcttggctcactgcaagcactccccatatcttaactgtggaatctccagaccatgtccagtcagtaatccattattagttttgtctcatgtgccctaaccaccttctctttaccttctatttcagccccaaataaaagttactattcttggctcaattctccaaatcctttgaaggtaactggtgacactatagcttttctttatgtgccaccttgtgatccaggcttcctagttatctgtgaatattcacatcaggttacctggactccatagaggcagcaccaacaaaaaacataattgggatatacaccacttttagactttcgattacatgccccaccttataatgtgtgaactgatttcacttctagacattcaactttcaaacaggtatgctctgtattaaacaccaacatcctccttccctttcactcaagggacatcgggaaaacaaaaagatgcaatgcaaagttcacatataaggataattatttgtgataatggtgacaatgatccctatttcttttcctgctcttatgaatttgcaaatgtcctacaaactgtattaaatgagtctgtgaaagttcatctaagtccctagtattattattttttaactctctagaaagtcctagccacgtagctcaaagcaaaatagaaaagatccaaatcattcataggacaagtgttgaggcaactttcaattactaaatatatttttagccatttaaaactaaaagaaaagtaacgtctgtaatcccagcactttgggatgctgaggcaggcggaacacaaggtcaggcgatcgagaccatcctggctaacacggtgaaaccccgtctctactaaaaatacaaaaaattagccaggcctggtggccggcgcctgtagtcccagctacccaggaggctgaggcaggagaatggcttgaacccgagaggcggagcttgcagtgagccgagatcacgtcactgcactctagcctgggcagcagagcgaaactccgtctcaaaaaaaaaaaaaaaaaaaagtaagaaaactcttttactcctttttatgatttaaattttattttaggtttgaaaagtgagctatatatcacttaacagtcaggaagcgtgcagtaaactcaatctctgaaccgacgttacctaaatcaaagatgttcgttttctcatactcatctctaaaacagaggtagacagagaaagtgcttctttttccgagattgtaatgaattcaaacctattcattaactttatagcagttattttggtttcacagtgaaacataaaaagttctattttattggaaagaaaaccaagtagctatctaagtagttcatgagaaggaatttgttctactgttttaagtgcatgagggataaagcaagacttagaaatatttttgttagaccatttcattttaatagtattttctattataacagaaatgacctacagtaaaataattcaaaatacccttacttctgaaggttatttccacataaaattgtaacattactatgatctaaatttaaataaattttctattgatgttaaaagtttgataatatacagtttgttaaagtggtttggtcactatttgggcacgatcgacttcaaaccataggtgtttaaatgaaccaaagtcttttgtttatttctatagctttttgcctagtttgattaataactagtataccagtcattcacatatagtcataactggccaaccaaggtttacttggtaggagggtgacagtttaccctttaataccacctgattaaaatacacaagatgttctacacaaataacaacaaattgtttatttctaagaacataattttccttttataggaagctctcaactttaatttggagtcacattttaattttataatgtaataattcaataaatggtcattagatattgggttatttggaaaactgcaaaaaatcaaacttctgacaatgtcctttaaaataattaactcagctggaaatagttaaacaagacttaaaaatacaaatcataatggccaggcatggtggctcacgcctgtaatcccagcactttgggaggctgaggcgggcggatcacgaggtcaggagatcgagaccacggtgaaaccccgtctctattaaaaatacaaaaaaacttagctgggagcagtagcgggtgcctgtagtcccagctacttgggaggctgaggacagagaatggcttgaatccgggaggcggaacttacagtgagccgagatcgcgccactgcactccagcctggggcaacagagcaagactccatctcaaaaaaaaaaaaaaaaaaaagaaaatacaaatcataacgtgaatattcaaatgattgtacagtgtaacaattgtatgcaaataattaagaatagtgactataataaaaaagtttaatagatttgacatcaacatttaaagaatataacttacatatacgaaaataagccatcaaaacttgaagctgtcaaattgtgaaaaacagtagtaaacaataaaaatcactgactcattggaaacactgcaaaatgtcatgaaaacatttcagaaatgaaggtacgttaatgaaaaataatcatagttttaaattcagtctcacctcacctttaagaaacagtgtaaaacagcaataaatgggataatttatattactgcaataaaatgcaaatatatatatattgtgtactagcaccctctcttcaatgtatactttaacccaatagctttctaccactggaaatttatcataagaaaataatggtggcttacacctataataccagcactctggtaggctgaggcagtaacgtcagttgagcctaggagttccagatcagcctgggcaaaatagtgggattctgtctctaccaaaaaaaaaaaaaaatgccagtcatagtggctggcacctgaatccttgctgcttgggagactcatatggacctaggctgatttgagcaggggtatcatttgagcacaggaggtcaagtctgcagtgagctatgatcattccatcgctgcagcctgggtgacagagcaagaccctgtcacacacgcaaaagaaaataattcagaatgcgcccaaaaatatataaatatatttctgaaagctgcatttgtaatactgcaaaatcaatgccacattgagacaggggtaccaagattaaggtagagtcaccaatgacaattaaaatctggagtcagaatgctgtatctaagtaggacaacaatttctctgctgcagcctaccattaccatgcagcaaagttgctctattacttctgaattttccacattcttaaagaaaagcagaaaatccagtttctaagacaaaaatcaagttataagtattgacagaaaaatcacttttaaataattgtaaaagtaacaacacactataacagtaaatctaattcagcctgataccaggctgtaccaatagatataatgaaactgcataatattggtaaaacaattgtatggtagaaaaatactggcataaaaatgttcatagcaaattcataaatggaaaaagtagtctgttttatttaaataaaaaggagctaaatgaatggcagacaactacaaattaatagtttatacctttcaagtttagaattaaggatatatttttctttattttttgttttcattattgtgatgtattatgctgaaattagcaaaaaaaaaaaaaaaaaaaaaaaaaaagagagtatctgaccaatacagaaatttgtattgagaagtaaggtgtgtccctaacaaacccacctatgagtcagtttgaaggtagcaagaaaatttttatcactgtcatatacttcagaagtatttgtgtacctaatgatttccagtgtcatcaaacataggtaagaacactgagtattagcactggttgatatttggtctctacaatagtgagtatggtggttaattttagatgtcaacttgaatggactaagggttgcctagagagctagtaaaacctattaaagtattatttaatatagtattgtagaatatacgttaaatacattatgttacatgtattctaatgcaacacattataatatattaaagacattattccattaatacagtacttagtatagtattacttaatacattaaaatggtaactaagcttgacgaatccctgagcaaagccagttagacctcataagcagcctctcaaccttgcttgttttgcaaacattaacaaaacttcaggtattttttgtaaatgcctatatgaaagaaaaacagaactttctttttctttccaaataggagtgtttactatagttttcctgtttctgtatcacattacacactgaatgtgtgggagagcagagagatttaatttacaagttttagatcaagagagcataaccagatcccaggttaagacttaacactacagaatactcatgttagtaatactcgtcctataaaaagatacacttttcactgtaattgctgcaaacaataaaatactgtaaaataatatgcagtgtgtttgtgaaaggtcaataacatgtttatatttttgctgttgaaaaactacacaaaaacaaatgactacaacagcagatcaattagtatcagtagaattataccatcaaaaattccactgagcttgaatgtaagatctgacataaccagataattccatggcaggggaataaactgcatttacattctctttctaacaattagtgcaagcatatccagataaactatattgattctacattatcttagagtgaaatcacctaataacttcttcagtagtctttcttttaatttttatcctaattatccgtctgaaaatgatcttttaaattgggaaaactctgattacattacatccttcagttcagagtagcattgggtaaagacattttggctgcagacaaatcactctttcatagtcatcagctttcagaacattctaagactttattttccatctaaacttttcagttaatttgactctaacttttaattgatgttactgagcagcaaaggagcctgaaggacactgctttgtttggaaaaatgaagaaagaaaggaatgtaaatcctgtaaatgtaattctaacgaaatcaagataaaatatagtgtttataaaaggaaatacaattatttctaataactgtactttcatttcaaataattttcaacaaattagtgatgtagaataaatacaattccagaagaatccaggattttttttctattgcatggctttttattaaattatagctacttgaaggctttgagaaattgaacaccagtaaaactgcccttcttttgttaatatgttttgttttcttttttcatttttaattcaactagtcattcacaagaaaaaattcactcaggtaaacttttttgattattctttcatagcatttaacgcgtgttatttattgtagtcttttgtctatgaatctattaatgctaagaaactgaacattcctaggagtgtcctaataagaaagaaacattaacaatttcagctgtatttttacttaaataaatattcatatagtttacctttcaggatcataacaaacactttaattatataagaaggtttttgtatatacatcagactaccaagaagtcatatctgattttgtgcttttctactactcttcccccaaacacttgttcaaaaagtttacttttaaagggtctgaactgtgtgtcaagcactgacatcagcatgttacctgaattaactcattaaactcttgtgatactcatgtggtattagcagtgaagaaactgaagcacagaagcttcaagtaaaatgtccggttttagagcaactgaacagtagagtatggaagcccagttactgaccttgtaccattgcccagtattgtgaactgacctaaaaaggcctatgagatatcaacccattaagatccatgacataaagaaaattgtttgtcctacaatatcccaatctggatgaaggcacataaagagaatatgcttaagcatgatgacaaaaaaataagaaagaactgtgaatgaactttacaaaacagaaaagaacacaagggactttggaaccaagttgaaaattaaatatgttcatgtgcacataacaaaagagtgatcataaataaactgtgtcaacactgtactatgaaggtgaaactttctttttaggattagttaaaccttgtataagttgtaaaaaaatgcaaccacatatattgatgtactaaacccaatgtttcttttggcttatatactaaaaacaggaattccttcctgtaatgaagaaaaaacacaggcatcaaggagtaacaaaattaatgtcttagaatctaaaatatagaaacaccaattaaggctttttttacataatacatgcaaaaactgcatcagaatttacaaaaaatctacagcgtaattggttctggcaataagcagtcacattctgctggaggtaactttagtaacgtcaagcaaaggtcttaaaattatgacaggtggtattcatttaaaatactcttaagagctcttagaaatcaagaacacagtatctggacccttatccacactcaatctctttctaactgggaaattttgggcaaagttttaaactttcttgaacataaaatgcctagctagcaataactttagaaaatactaggagtttgtaaagttacaagaatcaaatgagttaataaatgtaatgtacttaatgtaataatgtgcaaaataataattcattattttaatatctaaattctctagcttgtagttattttgaacagataaatatatataattaaaatttctaacatgtgtttttgattacttatcatgtagaaaaatacagctttccagatgaaaatatagtatataatgtagaagtcacaaataatatttattaaactggaatgctatcattttaaattattttggagctcattaaagtaagtctgcactggccaactttttatttattaattaaatttttgcctagcacagttaatctccttttctaagacttaattcccaaatctatagcctttcttttcccatttggagatgagtgggagtactgttcctttcttgccaatcccttcctctattttcattataataaccaatatgcccttgcctaagcatatgcccccagttaataatacagattcactgtactgtctcaccaaatttaacctgttatttttggaaacagggtttgtttaaaaatgggtttgttatttcttaatacatgccaaatgtcatcagtatatcgtggtccagatgtattctaaataccaattgaaaaacattcttaaagctaagaacacacaacatacttcacagagtgaacaactgtgagaagcctggggattgtaggcattcttggaaaactattatttttttttccatgtgtgtcaagcatttgcataggttatatgttttatagctccagttataaaaatagggaataaattatattccctcacatctgtacaaaatagcaagaatacacatctacagaagtttaaagtatttactctttttttttagttaatacgtttcagaaccttaaagagagcaaatcataatacccattgattataatgtcacattttagttattacattattacatttacttattataacttttagaattttaggagggaaaaaataattctgagtgtgaaatttgaatatttgcaccctaaaaatttccaattccattttcaataatttagtagaatgtttcttagagaaataagaagacaattaaaaatatgaagtactactaggttttcaagtatattgcaaagccataaataatatataatctatcagtggtacaataattaatatattttttcaattatattcagttgtaagaactcaatgctcctaaaatttttaaataatactatataaaagcaactcaaatgatatcagctcaaattcatgtatacatctttgcagctaacgtcttttaaaattaaaaataatttaaaattttgtcatacatttatgaacccattttaaagaacataacatgtcatacaaatgttaatttaatacacaatgcattagtaaaaactgttctgtatacatatgtttatgttagaaaactatttttaaacagcaattcgattctattgattcatcaaattattaaatcacaacattgctaaactcaatttttactctcctaagcatattggaatctatgagaatatacagtagagataataatttgaatagaatttaacttatatgttttagcaaagaagaaataaaaactggaatattatgggtttctaacatgcctatttgtttgttagttttccttttaaaaatttctttatagaagcattttgagtgaagcccacagattatttaataacttattagttatttaaaaaagtctgccttgttgacaatgtggaaaacaccatagagtggggtcccccaccccaggagctgcagaccagttagctgctcataacctgttaggaactgggcctcacagcaggaggtgacctgcgggacaggtaatgctgggtggcattaccacctgagctccgcctcttgtcagaactcagagcggcattagattctcataggaccaggaaccctactgttaactgcgcatgtgaagaatataggttgcacactccttatgagaatctaataactaatgcctgatgacgtaaagtggaagagtttcacatactcccccatccccacaacccactcacccagccatccctggtctgtgaaaaattttcttccacaaaactggtccctggtgccaaaaagtttggggaatgctgtgttaaggtgaaaaagggtacatgtggtaattgtaaaaaaaaaaagttcaataaatataggaaaaaactctaacatcatatgtatatgtggacatatatacttacatatacatgattttctgatttgaagaatgtataaaaaatgagaaaatgacattgaaaacctttttaaggatcattcattaatatactctcgctctctctatatatgtattatatactatatagtatatataatatataatacatataatatatagtatattatatattatatgtaatacatataatatatagtatatagtatatatattatatacatataatatataatatatagtatatatattatatacatatactatataatatatagtatatatatttattatatacatatataatatatagcatatagtatatagtatatatttatatacatatattatatattttatataatttatatttatatacatatatattatatataattacatattcatatatgtatatataatatataatacatgttttatatatattatatatatacattttatatagacagggtctcactatgttgctcaggctggtcttaaactctagctcaagtgatccagtcttggcctcccaaagtgctgggattacgggcataagccactgtgcctggcccatagttaagtacttaagtcaaaactgatcattgtacctcctttctcttcctcgcttcattcttgaaaggaattcaacactgaaaaagaggtggagacttaactgagtcattcacaaataagaactttagaaaagtgaaaaaacatagttatacaaatcatttccaatgatttgttcatctttaaaacataggccaatatttctattttacccaactttactcagctgtaggatgcagtccagaaacatcttagtgtaagagtattttttcataaaatgtaagatattttattcaaattgaatggctgatcagccataagaattccactgtaaagtaaccaaagaagtacaattcttacaaaacaatcatgaaatagttttaagaattaaagaaaaagtaatcacttttcaccaggaatcaaacttttagttggcatagcataaaataatttctcacactggcaaaaggaaaacctccagaaacctccaggcaaatgtcctttccccactcccactcctaaagaaaatatgggctagaccgaggcaccatgatctctcctgcctcttggatttgctctctgtatcccagggctgtcttctagtctaatctcactcataaagctgagcaaatggcataccaagacagaggatctaacatgtgtttgaccttttggaggcatctcaagtccctggattccacctcctgttctccgtattttcaaacatgttctcgaatatgtgtttgacctttctgaagtatcactagtccctggattccacctcctgttctatatattttgtaatgttaatgtccaatttcatttttaaaatgtgagtttctacacaagttgtttcttatttgtacccgaagactttgaataggctctggcactcccagacatgggatatcaaacagatgcaggccttaagtaggtcataggactggacttacatacaagtggctgtggcttgtgagactaggttgtagtggtttttttgttgttgttttgttttttcattttgtctaaggacttgaaaaccttcaggggagacgtgagttaagatttgtcttcttctagtgatcttcttttaaaacacaaatcaatcctgttaaggaatccattaaattactattagtgcgaatggacttttttaggtagcatggatgaattcaatgtaaatgcaaatgtagtatgtggaagaagagccattctcattctatgaacataggacaaggatgagaatatatataacctatagttaatgaaaaatatatatttctgatttatgtgaaatcaatttaagagattacataaatatattctatagatataatatgattttcatcagagcacagaggatgaagagagaagagagaagataggagtggtggctactagatccttttgggggattatttttaaaaaggcagtttttggcaataaaaggggactaacaccttctaatagatatccactggcttgcagaaaacaaagtgtcagaaaatttatcattggagaaaagtcaatgtttccattagtattaatgtggctaaagatggctcaagggtaaaattattcaaaatactatgcatcacaatagtgccaccctgtggactactctctctctcaccctatggggaaaggggctatgtgaaaagaaaaagaatttctagcgcagcaaaacaaaattctttaatttttttacatagaaattgatagtgtttgctatcagtgatgtaattattttacaaagaagcccttgaactatggcagaacttctggatgctctgtcactatgtgtcaatctcaatatatcaatcataacacgtgtgatttggggttaatatgaaggaaaaacaaacttctcttcggttaagtatattttccgagatttaaattagtttcccaatttttttccccaggtttccaaattcttagtgtaacaccaaccaaatatcaaaatagattattagagtttcgatacaataaataaaattaaagagtaagcttataattcacattatttaattacatgcattattagagaggacatttcattaaagcatgcaagttgcattttttttttttaaattttgacatgtagatagtttaaactaaaagccagccaacactttgatatagcagaagacaactgggaaatgtcagttgactaaagtggttatttaaagaaaataaggaaacacaatattctttttgtctattgatatgtgatgctgtactgttattgggcaaactttttaaataatagaaaactctaatgcttacgatgacaaaaacatgttctgtaaaatagcactgtatatgaaaatagtacaaaagggggaaattagaactctgacaccacagtatcaatgaacatcacacagactgaagatcacagtagtgaatgaccaacatctttaggctggaaagagtgggaaaaattaagaatttcatggagatgttattttcaaaaatagactcaataaaatcaccaaactcaccactgggttcagaatgtgatcaaccatctctttcacttttatgttacctttgtggagttttattaatggaaatgaagaaatttactagaaaaacatgattgcaggcactgttaaatttactttctctttgtataatttcatgaaagtgacctgaactgctttgcagcattagtagggaaaaagataaatttatgaaattaaaaggtgagaatacataaaaagtttttatctttccagtgagaaagtgataatcataatgtttagttaaagctatcatctaaccaaacccatcagtacgctaattgtttttaacttgagattttaataatgctgaagtatttccgtcacctcagtattagtgcttccttgtttaaatctcaaagggccaccatccaaggctgcaaatatacaaatgataaaattttggtatttaagaatacccatcttctagtaggacagccatgacaataataatggctttgatagaagaaaacaagaaaatttcaagaagataaatactagggaaagtttttagattaacatgcaagtatgataccctccctcacaaaaataaagttcattaacactaagcctgtaaatttcatagaatacttcttgaactaggagaactggaatcacccatcctgttagaatgcaattaattggaccctcttgaacccgtatcttgtgtgtcaggagttgtaaatctgttaagcatcttcaggcactaaacaagatctgaatactaatgggttcatttatttcactgattactgtatgcagatatgaaattccaggcactgatttttcattaaaccactctcttaaggttaacttgcccctctcttttcacctgaatccatatgcttgccacgtaaattgtaatattgatttttaacatttccccacagttcaaaaatattgtttgcaaaaaatcaagggccttttctaacaattcatgtaattcctgttattagctaatgtgtaagagtagggaacaattaaacatactgtatacaaaatcttaccatcctgaattgcacccaagatattagttcagtcatccttcaaattacctcacaactaaaaaggatcagatacttaaataaaaacttcaggcaaggtaggaaagaagtcttttatcatccctgtatattgcaaaagtgttccattctctctaaattcacattatatttattaatgagcagcacatggaaagaaagaaaatgagagagagagagaaaaagagaaagaaggaaggaaggaaggaaggaaggagagaaggaagagaagaaaagataaagaaggaaagaagtcaggatggtaggaaagtgagagacagaaggagagctagagataacgatgagagaattaaaagagggaaactctaatgtctttgatatcccccaatttaaaagagaaggatgtgaccccctcccccgtttacatataatggaacaagccaagtctccattcactgcatgtggacagtaagaaaacttgcatggggaaaacttttggggggaaatgaaggtgatttccgagctgctactgcagttatatatgacactgacatttatttcccataattcttgcccacaggaaacacatcctttaagaaactgaataaaatcaagtttgacattctcataatctgcaaggtatcaacttccctgagaagctcacattcccccaaaacacacacatgtatgtaaggagcgagacattcaggagatgagctgtgaaaggtacttccacattgtgagggtgccaaggatttggttattcctgaacctgaatccgaaaagcgggggtggggtttgcgatgacaaatgagggtgagaagaatgtttccatgaaaccagacacccttttggaatctaggctgagaatcaggatcccacccccttgcctaccgccaggctccagtaagcaacctctggcgtcctcccctctgctccttccgcagcagcagacatagggatccctagcagccagggagcttaggtcccgccgagagctcctgccaagcgcttctctctcgactagttatcaattgagaaaaaaaggatcagactcacaacaaggatggtgatcaaaatccagtgtcaggcaccagggtcccagaaggttccggctcctcttctgcgcccttacccagctcttttcgcctcgcaaagggtcacccagggagccaccagcagcagatccttcccttttgctcctcctgatagcgccaatcttcgccaccactgccacactgcgcgcccgctatccactcacggcacaccgagaaggcctggcggagacagcgcagggggaggagggtggattaaaaggatagatttttggaagggtaagggagaaaaactttgatgttgtacccacacacaggactgagaagaaaccaaaagaagttgcagcttcaggagctgggaggacgctttcgccagctcggaaaaaaaataataataaatcaccccctaccaaaatcagggggaggaatcttcctgctccttgagcgatcactgagcacacctcgcaatctctgatcttcgaacccactgaaaaagcacaaggcatggggagtcctgttggttcacgcccggggtgcgaataccaaaagcacctcccgctggaaaggctgcaggaatctcgaggcaaagacagaggcaaacgcaacgctgggaagagcgaggggtgctgccatctgcaaaagcagagacgcgtctcccttcgggcaaagtgactgttacaaagtctgttccctcctgcgcaaggacagagacatttaaaggcctgaacggacgtcagcaccagtcgagctcgctgggtgagcgccaggtctccccaccccaaggatagcgcgcacagggcgatctgctgctcgcgaggtagagagtggcttacttggggagaaaacattgaatctgtaaattaccttgggcagtatggccattttcacgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcatttgtgaatgggagttcactcatgatttggctctctgtttgtctgttgttggtgtataggaatgcttgtgattcttgcacattgattttgtatcctgagactttgctgaagttgcttatcagcttaaggagattttgggctgagacaatggggttttctagatatacaatcatgtcatctgcaaacagggacaatttgacttcctcttttcctaattcaataccctttatttccttctcctgcctaattgccctggccagaacttccaacactatgttgaataggagtggtgagagagggcatccctgtcttgtgccagttttcaaagggaatgcttccagtttttgcccgttcagtatgatattggctgtgggtctgccatagatagctcttattattttgaaatacgccccatcaatacctaatttattgagagtttttagcatgaagagttgttgaattttgtcaaaggccttttctgcatctattgagatgatcatgtggtttttatctttggctctgtttatatgctggattacatttattgatttgcgtatattgaaccagccttgcatcccagggatgaagcccacttgatcatggtggataagctttttgatgtgctgctggattcggtttgccagtatgttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctgttagaattcggctgtgagtccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgtttcttctctctttttttctttattagtcttgctagcggtctatcaattttgttgatcctttccaaaaaaccagctcctggattcattaagtttttgaagattcaatgccaaccccatcaagctaccaatgcctttcttcacagaattggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaatacagccctcagaaataacgccacatatctacaactatctgatctttgacaaacctgacaaaaacaagcaatggggaaaggattccctatttaataaatggtgctgggaaaactggctagccatatgtagaaagctgaaactggataccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaagaacaaacaaccccatcaaaaagtgggcgaacgacatgaacagacacttctcaaaagaagacatttatgcagccaaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaaataggaatgcttttacactgttggtgggactgtaaactagttcgaccattgtggaagtcagtgtggcgattcctcagggatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacagatacaccatggaataccgtgcagccataaaaaatgatgagttcatgtcctttgtagggacatggatgaaattggaaatcatcattctcagtaaactatcgcaagagcaaaaaaccaaacaccgcatattctcactcataggtgggaattgaacaatgagatcacatggacacaggaaggggaacaacacactctggggactgttgtggggtagggggagcggggagggatagcactgggaggtatacctaatgctaggtgacgagttagtgggtgcagcacaccagcatggcacatgtatacgtatgtaactaacctgcacaatgtgcacatgtaccctaaaacttaaaagtataataataaaaattaaattaaaaaaaaaaaagaaaacagatctggtggcgctgctgagtgtcaaaccctggagcccatcatcaagacgttatactggtggcagttctgctgtgagtgcacttgccgaattgaacagagccagagctgcgtggagagagagctggccactctgcacgcgcgcagccaatattgggttaccaaggagctcaacacctggtttttagaaaaaaacacttctctctttaactctggtttgagtcagtattctgatttgcttctgaaagttagttgaaatccatcgagatgtctttcacaagaaagggattagactttcccgtcttggaattccaatcaagataatacttaatctttccttaacccccactgtgtacttcctaactcacagtcacaatggatgaaagtattcaagcatcttcaaatgaccattaccctgcattctaagacgatttgcctacttagacgtcctttagtaactgcaaattatattttttcaagttcgtttgccagctggcttcagatcaggttcagtcaatgaaaactggtgtgtaggaaattggccggtgcccaaagagtaacagttaggttgttcctcctcctttgcctctgctatgggtgacatctacaccattacctgtcctctaagtggttctagcttccatcagggaatgctggctccttgtctttagtagcttgaccttccccctttatactttcaacctgtttctgattataatttgacttctcatataatcagagggagacaatttactgatttcaatcaattactattctctatattttatttatcatactataagactgcattttatgtgtgttttaagcatgattcagccactcaaaatttgacaagagcagcattggtatcttccaaaaggaaggtcaaatcctgctgtgtggtaaactaattaccataagatctacaaactacaggcttagggttttactttgatgactgttatttttataattctgagtatcagtgttcaacatatttgatggctatcctcatcaaatgatcctaatttatttattcactaatttatgtactctttgaaaatatgtattgacatcttctgtatccctgtcctcatacatctctcagttttgttgcaacagaggaaagaatatggtgaaacaaggagttggccccttcttgacaacttgtgcagacacaagtgctttgaatggggaagagactgggaatgcaattttcttagtgtggtgagctattctgcaatattataacagattcaatatctaaagagctgcaactcaaaatgaataagataaattgaagtgttgtgatttaagtgcaaattaaactctcaaaaacattaaaatacaggttttgcctgtaattaacaaagcaaagagagagtgtaaatcttatgcagcaattagattggtccatggtaaaacggaggtagctggtaatttatttttctatgttggggaagaaatttaaaaacaaatatagtaaacagcaattaatgttttatgatttgtaaataaagttatatttttaagattgaagcctctcttaccattctcaaagagccatttcaagccttgaatctctcagggcttcagtctgaattattataactttccagtttgagaacatttttcatttattcaacacttaaattgtatgagattatattttcaggaacaattatgtttattttttatatgaaataaaagtggacaaaatattaactgataattgtaaaagtattacaagaaatacaaggcatattataattatgtgtcaataaaaagagaaatgcctgtaaaattataataaatcattcaaatatcttaaaagcaaaatgcataaaatgtagaatgtatatattttcatttgaatgaccattttttaattaaaaaaataaaaggattcttaaaacattcaattagaaactacggattttcagcttttcccgattctattagaaatgtaaaacaaaataaatttaaattcaaaaacatgacagacccttcataatgttttctctgcctactcattccatgtcacttctaatttctccctccatacaaaatatgttgaaatcatactaaatctttgccttctgtgcttttattgtaacacactccatcatctttacagttgcaattttctgttcatataatttgccttctttcttccattttatggcttagcatctttttatctttcttggatcatctaaggtttagttttcttgtggaaatttacattggctgcacttcctagatattcccattgggcgttgatttcctcttatagcacttcctccactgcgatgtgttgccacactaactaacatagctaacctgttatacagtaagaactgttaggagagagttaggataaaaagactaaagtgggtagagttagggtttgggttacaatactagctgtatcttgatttgctagcatagcatacatactagtcaacaagtatatatgtattgaatatacctataaataaatcaataataacttttaaaacatagacctttggtttgtatcttataaaaagcttccctaaaatgtatgaaaggtctcactgactttatgaaatatacattgctctgatttcttatttatttttatttatttatttatttattttgagacagagtacctctgtcacccaggctggagtgcagtgtcacaatcttggctcactgcaacctccgtctactgtgttcaagcaattctcctgcctcagcctcccgagtagctgggattacaggcgcatgccaccataccagctaatttttatatttttagtagagatggggtttcaccatgttggccaggctggtctcaaactcctggcctcgtaatctgcctgccttggcctctcaaagtgctggggttgcaggcgtgagtcaccgtgcctggccccttgctctgatcttagtcttcttaggctctggtccttaatatttgagaatgtctgacaggacccgtgaattttattttttaaaaattgtatatgcccaaaatttgcatgcagtttgtatggaattttgcaaaatgtatggaaatcctgaagtctggcttgtttttttcttttttttttttttggcagggtctcgttctgttacccagactgggatgtggtggtgttatcgtagcttactaccttgaactgctggactcaagcaatcctccaggctcagcctctgagtagctgagattaaaggcatgtaacaccatgcccagcttattttattttatttttttcagagacaaaatcttgcattgttgcccaatctggtctcaaactcctgtcctcaagtgatcctcctgtctaggcctattaatcccaaagggctgggattccaaacatgagcggctgtgctcagccttgaggttctggctgtaatctggctgttatttatggaaacaacagaagttcttggtattagcagcagtcattcttcttgagagagtcaccccacaagactgagatgaatatatttaagaacccaaaatgaggtcattatggcagaacagaattgatagtgcacattaaaagacattacacactttgggtgattcaactaaatcatagtctgaaatgcagttacaaagtggtaatgttcaaaagatcatctattagtcaaagttacaaggaaagtcctggttatgttggtaaaaattgatatctgtgattatccatcttcaaatgatttgttaaatgtttattaagataaaaaagttacatttcaaaagtatttatattatttgtcaattcctccataacaaattatcccaaaataaagtataataataaaatttaaaaaaagatgagaaacatattcttcaccacaggaaaaaaaaaacaacctttattatctcaaagtttctgtggtgcaggaatctgggcatggcttaactgggtcttccattcagagactctcacaagttataatcaatctcactcacatgcttgatggtgtattcagtactttgacagctgttgtccagaattccatataatgtgagcctcttcggtatggaaggtttcttcatcaaaatgtgccaagccaaaaaaaaaaaagctattgaaaagagtccaagacagaagtcacatcttttgtcacctaatcacagaatcaacctctcatcatgtttgctgtattctatgcaacagcagcaagcctatagatccagctgacacccatggggaaggtattagacaagggttggaatcccaggagatggagaccattagaaacaatattaatctgctgattacagtagtttgccaaagaatcctgagataataattctgggctcaaaattcttatgaggcactgaggcaggacaataaaggaacagaaaataatactatattaattttaatgatttattaatactaatatactggtataatgtgctaaaatagtatactacatttttggtaatttgtccaggagtaatagaaacaaatccaaatattaaatatcaaagcatattataattctatgataattaactctgtaatttaaaaagtctaatataggaatataccaaaaaagaaagttttaaaaatatactttatttcctaatatatcaaaatggagccttcacatatgaaattagtaaaatatttttgacctaataatttcatttttagcttttctcttaagaagtcatattgtttgcaaaaatgttatgtaccaaggagtttataacatgcagttgtagtcaggaaaaattttaaattaaaaatgtgcaataaatatatgtaaaaacagaataatataggcatctaaatagccctatataaaaagacaaacataacattacaaattagcattaaccaaaaatatgctctgaagtacatcccttgattaaatttacttaagtttcttttggaaaaaaataaaaataattgtatttgctagtaagagaaggtagaacattatttgcccatttgttttcagaagtaaaacaagacatttatgttttcagaagtaaaacaaatacaatattttctaagtaataaggttgagacaagaaaaaaacagcaatgagtaaaaatgtctatttacatgcttttacaggaaaacaagacttaactactttcttccaaaaaaaaatttaagtagaaatgttattgttttactaaaagtaaatacattttacatacttctctcataattttaatctgaagttcagttatggtgatcatattagtcagtgttttccagagaaacagaaccaacaggagagaaaaagagacagggagatgaaataaggcattgtttagcatgattatgggggaaaagacgtcccaagatctgcagtcagcaatctggagactcaggagagatggtggcatagctccagtgtgaaagctggcaggtttgacactcaatgaaagccaaagtttcagtttgagtccaaaggtgggaagaaaccaatgtcccatctcaatgcattcaggtaggaggaagttccttcttactcctaggaaattcagcctttttattctattcaagatttccactgattgatgggacccacccacatcattggggaagtctactttactcagtctatgaattcaatagagaaaaagatatacataagctatcatttaaatttttaaaaaatcatttctaatcaaaatgtagcattttaattgtgtttttagagttttgtaagtgtccttaatttttcagcttattcttaaaaaatcaatttcactttattcaaaattcccttttggaaaacattaaatggtggcccatataatcttagactttacatgctttttgataaatataacattaaaagtagcatgtgtagtaatttaaattacatatataagatgtacatatattattctccagaggaaataaaactgttaagaactctgatttagtcagggttctccagagaaacagaagtgatagaagatgtgtgtgtgtgtgtgtgtgtgtgtgtgtgtgtatacatatatatatatatatagagagagagagagagacagagagcgagagaagaagtgaagagaagacatttattaggagaattggcttatctgatttcagaggctaagaagtctcataataggccatgtgcaagctggagaaccaagaaagttgttagcatggctcagtccaaatccagaggcctttccagactttaccactaatcaatacactatatttagaaaggtatcataataagtctctatttcaatttaaaattctctattttcagagacaatgaaggacaaagggtcaaattttacaattattgtgaaaagagattatagagaaagggcctggataataccaaaaatagaagaaagaaccatccatctggggcagagaatcagcagtgatattacttgaaatatggaaattaataatatgtaaggttgagtttaagatctaaaatataaaagttaaatttaaatctaacatatatgatttaactctctagaatatatctactcaattatatgaaacaagcgggctgattctcaatactttatcaataataaaggtttttccaaatagttttgaagaaatatcaaagtgtctaaaaaaaaagccttagaccatgaaccatagagaaaaagacaaggtttgccatgaaaagtgaataacctttttatttccagttgtgatgtgttgatacaaaccattagcactttcatttcagtgaattatgccagttcttgctttaccttgtcaagattatatatatgattatataagccaaacatgcttccaagctgtaactcacaccaaaataataaagactgcgaatgaacgactatatttaataaaaaacaaaatcatacacttattttagatttgaaaatgtttgggcaataggttaattagatctcttttgagtgttttgtttgggatgtgtgtgcatatgaatctgagtgtatgtctttgtgtgtgtcatcagctcaacccaccttgaagaaaaaaatatgataaaataaataaataaaatatatattatcagaattcggtacagataaaaagtacaaaatttgatgaagatctctgtcttgtttatcattacacaagaaaggaaaaaattggaatataaggcaaaaattgtttgttcatactagctacttttgaacactgctctgcccaacaattttgcatccattaaaataaatataagaatcaaatatttcaaagcaatgctataaaatacttgtatgtagaaatttgttgatgccctcctcagcatcctgtccatgtcttattttatatcagcacaattcacaattgcaaaaacatgtaacgagcccaaatgcccatcaataagtagattaagaaattgtgatataaaaaaataaatatatggggatactattcagccacaaaacgaaaaaataatggggattcacagcaacctggatggaatcagagactattattctaagtgaagtaacgtcagaatggaaaaccaaacatcgtatgccctcgctcgtatgcgggaactaagctatgaggatgcaaaggcattagactactacaatggactttggggacttgggagaaagggtgtggggcgtgaggaataaaagactacaaattggatagtgtatactgcacaggtgttgggtgcatcaaaatctcactaatcacctctaaagaacttactcttataatcaaacaccacctgttccctaaaaacctatggaaataaaataaaatgaagaaattttgtgtatgcataccacatattttttaacttttttcacaggttcattgagatataatttatatattatttaattcactcatataaagtataaaattcaattttttagtgcattaagtgggtgaatatgcaatcaccacaacataattctagaacatttttatgctccttaaaagaaaccttgcgcccattagcaatctttcctcattttccctactctttctttaaacccctcccagccttaggcaaccatccatctacttcctaactaaggatttgcctattctggaaggatttgcctatcctagacatttcatgtaagtggaatcataataatatatagttacatgtgtctcactactttcacttattatgttttcaatgttcatcctttttggagcatgtattaatacctttttctttttcattgccaagtaatgtattttatggacaggccacattttattaatctactcctcaattgatgaacatttctgttgtttcctactttttgttgctataaatacttgtatgctactttttgtgtagacgtttgttttaatttttttggtgtacacataggagtgaattactgagtcacgtggtaattctatacttaaacttttgaagaactgtttcatttttctgcatgatgcttgccaattatcccagcaccatatattgaagagtgtcctttccccactttatgttttgtttgctttatcaaatatcagatctgtagattgctttgggtagcattgagattttgacaatattattttttgagttcataaatataggatatttttctatttatttatgtcacttccaactttcatcaatgtgctataattttcagtatacacatttttcacatcctacattaaaattactccttagtattttatttacttatatatttgttttgatgctactataaatgtaattactttattaatttatttttcagatagtttatcatgggtgtttagaaacaagaatactatttgtatgttaattttgtaactctcaactttattgaatgtgtttatcagctttaacgggtttttttggtggagtctaagattttctttatgttaggattacattttcagaaaacacagacgatctcaccccttcctttcctatttggatgcctttcatttcttggccttgtataattactctggatagtagattacatacaatgttttcagcatttgtaatttgacatgaaatccatctgttgcaatacactgattttcacttttcaacttgaaaacctggacatttatcactactctccctttctcttggtctagtccttatttaaaaaaaaaacctaccaatctaaactaggataattatttttctataaaacaatttcaaaggcatttaaaaaatttaacaatttttaaactttctatgtcaatgattttaaactgcggtctctcaaaacaaatccaatacctttagtaggaaaaattatgttaattcctacactatcattgggtctagccaagagttgatattaatagatatgcttatttattaccttgttctaacagttgtagtgtaagtcttgaaaatcaagtaaaaatttgtaaagattataatcgcacaaactccctctctcatgaggcacacagttaatccaaaatattatttctaacttaccataaagccaacaagtaaatacaatgtagtgtttaaaaataatcataagtatattctagaaatgaaacattaattgatactatttattgaatatctcatatttatttacatagaaacaaaggaatcaaaagcatattatgtaacattgaaatgactaaaaatacttgagatagcattgctacataaatgctatgtaaatgctgacaaaagtaaaaatgccattcgctacatttgctaaacatactgtgacacattataagtattttaaagatatatcactaatgcttgggtcaagtgggcaaaaatgattctaagtatttaattgtggaaaaatttagtgcaggggatagtattcatgtgatggaaaaattttaagtggaactcagagattagaagcagcaggaagttttaataacgtaccaggtgcagtgtataggatacaagacagaactataggtaaagtctgagtctttccagcatagctaggagacatggctaactccacctgtccccaggccttacctagaagttgaacagctccaaaccaggtaaacagaacaattttccaaagtcaatcaatttatgacgttaaagcacttctaaaatttaacctctgacttaaattagacaaaatggataaattttgatgatttttttaccaatgattttaacactgtctttatttcccaaagattactgaagtcatgtgaaataaaaggcattggagattctatttttctgacaaaatatgtaagagccttccttttcttctaagccaagtaattagggctcctttatatatatacatacatacacaacacttctagacaggaaacgatctagcagttgtaagtttttctttctcattttatgaatcctaacacaacttccatagaccatctatgacatgaactttctgacttttcctgtatttccctctttcataattagtcattctactttaggacaagaatttgccatacaagatcctctctcttgtaacatttatttccttcataactttcttaccataaatacatcttcatatccacaactttctttacatctccctccccgactgatttctgatccccatccaaacctaaaaggtcagataacacaaagcaaaacaagggagagctttacattttgagagagacctgtctgcctgaagttcttgggattccatgaggacaaagaggtttctcctaaaatgggttttgtagcaccttctgtttttctttaaggagtcccagcctgtcagaaattaccttagatcctctcatgtgggcactgagtggcaacaagacagactagggaacactggcaacaagacagacaactgagtagaaaaagaaaaactacagtccccactgtaaagatggataaactgaggcatcatgcagtttaaaaatgcatgttacatagagttgggctccacagctcactctcttaaccatcctgtaattttgcctaacctatgcccagtcactgatgcacctgtatggtacttcatggcccccttagagcttagaacctgggtttcattcctgctctacagctatataatttaacaattttcttctgaatttgttggattctaaccctatgcttctaaaattttattaatattactgaatcttaaagggagctttaagatgtctttagtctttagaaatactaaacctataaacaaaggactatatgaagttaaaactgtattcaaatttctacatgttttaagacactgaggcaacgtattaagaaacacacctaagacaatcaatctactctggacaaaaatttagatatggtctcttctaaataagctacctagtggtatttatacatattcttccttatatcaaccgtatcttacatgctcatagccttaaaaataactaaaaagtgtcagaattataggccttacacatttctgttggcttgaaaaatgatacaaaatgcataaacttctagagtgatcagtttaaaaaaggagttcataccaaaggtagtaatactaggaatcaaagagggctaaactctgcaggtttttaaaggtgaaagttaataaaaccttgtttttcattgtgaatctttgccttacaacattatacacatgattcttcccccttctttttcctcttgcaaagatgtggtgatgaaccctttgctcatgcagatgacaatactcttgaaaatggtggcagagaaaaaaaatgaagggaatatggttcacttaatcatctcataaattagaacttattacccctgtgactcctgaatagctccagaaaaaatatgtgagagacatgaaatggctgtttgctaccaatattttatgtgatgcttcattttttgattccttgaagaacacaacgcattagcccatttatgcgagaggttgcaactttttgaatttttgcataagtgaaaaattagaccttgtcgatgacatttagcagtaggatacaagtaattcccacgtgcttggcgtggaacactaggcataagtgggttaacacaattacgaaagcatagctattcaagtaactaattatacaactgacttttttttcctcatctctaaaacatagggatcagttatttaaaaaacacagtgacaagtattttatttttaactcagttttggtttgttaagggcgttgcttggcataaaaaaaacaaaaacaggaggagaaacaagaatacaaacatgacatagaagcagtagcaaaagaaaatgaagagtatcaagaaaatgagaagaaaatacacaatggaagaaaggaaaaagaacaggtgtgggaattaaaaggcctattatgataccttttatcccctcctcgattcataaaatttgagtaactccaagagtatcacaacaaaaaacaagcaaaaggatacacaaatagtcaccccctaaatttggttaggaatgagataatgctgccactcaagcctagctcgggcaccagcaggaggagggcaccctccagagactgcaggagaagggggaggactcctctttgccctatatgtaccaccaccactgccaccgaggccttcgttacaacacccacaggttcctccccaccccagaacgggatgggccctgcagtgctcctactcccccttcccagcccccagacttcctactgctaccaccactagcgccgatgccaatacaaccactgtcaccctcaatgtaccagcccaccctaccaggctcctaccacctggtccccgtgggtgccctcctaccgctccagttgagctgcagtctccatctctaccaccaacttcatgaggcaagtttcagagccatgtcatctgctcgaccataccactggcgactcctccttctcctcctgcagcctggcttggagcagctgggcaggcaaagctagaaaagcccaaaacgggactcagggagtgcaaccgttagagcctcaccttgtcatgctggtgactgggtttcagggatcagtttcattgaaggcactcacacccacttccaaagtccagcctctcctcttctggcaaaagctggccaggaactggggcctggggtgggagtgagtgccttcactgaaaccagcccctggccaagtccagctggccaggaattgctgggcccaccaaggctgccctcctcagggagcctgagtaggagaaactcagacccagccagccctccccacccaagagctggttccctttcctgacacctccacccaaagtgccctgtcccccacttcccccatggtgcctcctactacctacccggtagtcccaggtggtcttcccaacacagagcatgagggcgggccagaaaaccacagtgggtgtgggggccctgccctgcaatctagctcgagcgggagaaaattgccttctagagtctggcatctgagaagagaacgatcccttacttggagaccaccagaagaaggaggccactgctgtcactgccgccaccacctcctcagctcgccagcgccactggcagtgtagcccccatagcacccctaatctgccccctgccactagtagtgtagcccccggatagcacatccaacacaccctagtttcaggcaatgtaaccccaatatccccctaaagcactccctccacacctcagggagcataacacccggtagttctcacaatctgacccagccacaggcagttcagctcctgatggcgcactccccagtcacaggcagtgcagcacccaacaacgcccctaaaccaccgcccactgccagcattgtagccccggataactccacccaacccaccccctgccgcgggtagtgcagcagaagatagtgcccctaatccttccccagccacctgcagtacacattagtgtacacaatctgcctccccgacaccacccctgccaccatgggctgtatagccccggatagccagccaacctgccccactaccagcaatgcaacactggagagtgcccccaaccagaccactgccacaggcagagtagcctctagcagtgagcgccaataggacacccaacccttgtccccagaggcatacggggcagcctcagaaaactcacctaccccatcacatttctaccactgtggccgagctgcagtctctgacgtcaccaccaaccacagcgaggtaagccacggtggcacaggctccagcctccagcatgtggcggttcctcttcgttctagtcctccagcccagcaggagaagctcctgctgccggctgccctcctactgctctctcgccaccaccaaccgcagcgaggtagtgtcccaggctccaggctccatccatcctccagtctccagcaagcggaaggttgcggcctcttccagttttctaagttgggcacagagcagctcctctgcttggcacagaagagcctgaaatgacgtgacacgacctcagcatgctttatataccgaggttaatgcaaatgtggttcctggactacatgttctgataggacgagaaaaaaacctctaggcctactctgattggactttattttcatgctgtgatttgttgtgttaagacttgctctcatccaattacaacattataataaagtccaatcagagtaagcctggaggttttttctcatctactcaaaacatgcagcccaggaaccctcctgggcataactgcagtatataaatgatgctgaagagggatgaggttttttcgggttcatgtatcttcctgtggagttgctcggtgtagaggactaggaatcaggagtcactggcctcctatgctaggggctggagccgtgggagcggcggctcacctcgctgtggttgttggcagcgacggagctggcagcgcggctggagtggtaggagacggaaaacagttttaggatagatggaggggagtaaagagggtagatagtgccaaagggaaaaaaaggtagcttagtcagagaaggagttgcaaaaaggtggtagtgaaaagatggtgggggaaaaagtttttgggtagatggaggcagaaaaacagggtggggagtgggaaggaaggaaggttttgcagaaagacggtgggtaaaaagtttaaaggtagatggagggggaaaagagggcgtcaagtgggaggaggaaaaagagggagatgatgggggaaaacgggggtgagcagtagggagagaaggtttcgtgaaaagatggtggggtgaaaatagagtggggggggaaggtttttgggtagaggagcaaaagagggcagcaagtgggagaaggaaaaagagggtagccagcaggaggaagacaaagttttgtgaaaagacagtggcagaaaagaaagaccatggacaaagaaaagacggtgggtgaaaagtgtttcgatagatggaggggggaaagagggtgacgaggaaagagggtagcaagagggagcagggatagagggttgggaaaacgacggaaaaataatttggggtagatggagggcaaaaaagagggtggcaagcaggatggggaaagaagagcatgagcggtaaagggaggagactttgaaaagatggtggggaaagtttttgggggtagatggagggggaaaagatggaggtgagcaggagtggggagaaggctttgtgaaaagacggggggtggaaatgtttttgggtagatggagaagggaaagagaatggcaaggaggaacgggggaaagatgatgatgagaacagtttttgggtggatgaaggggaaaagaggttggtgagcagcaggagtggggagaaggtttagggaaaagacgggggaaaatgtttttgcttagatgaaggagcaaaagagggtggtgagagtgggagggggaaaaagagggtggccagggtaaggggaaaagacggtgggaagaaactggggaaagggtttgggtagatggatggggaaaagagtgttgagcaggagagtagagaaggctttgtgaaatgagggtgggcaaaaaatggtgaagtttgggggcagatggcagaagaaaaagggtggcgagagggagggggctaaaggcggtcgggaaaagaaggtagggaaataattttgggggacaaaggtttggggtagattttttaaaataagattatttgtatttttgattttgatgagttctttattttgtgtatgaaccccttgcctgatgcatagtttgcaaatacttgcttccattctctgggttgtttcttcatttttaaaaaattttaatttaatttttttttgacggagtcttgctctgtcgcccaggttcagtgcagtggcacaatctctgctcaatgcaagctctgcctcctgggttcacaccattttcctgcctgggcctcctgagtagctggaactacaggcgcctgccaccacgccaggacactttttttgtatttttagtagagacggggtttcaccgtgttagccaggatggtctcgatctcctgatctcgtgatccgctggcctcggcctcccaaagtgctgggattacaggcgtgagccactgtgcctggccttgaaacataactttattttttatttttgtatttgtatatatactttagtagccctgagttttaataaagttgcctttaaaatatgtatcttatttttcagaaatataccctaaggcatgtgattagttgggtggcatgttctttagtttttacaattgaaggattgtcattcctttatacaaaaaaagtgaatttttatcatatgctagaggaaagaaggtagatactaaataaatactgtatgcttccatgtagataaaatttgaaattatataaagacacaataccttaaacttttctggggttaaagtggggaatttcattggcaaagttcatgcaataaatgtgtaggtgaagggaacattccatatttgattatgtaggtgattatcaagctttataaatttataaaactgaactggactaaaatgtgtgccttacacgcaaattataattctataaaattgattaaaactagttagataagagagaatcaaggggaaaagagaaaaggcacgtgaaaaaataatgccaatgcactagaattatctttgatgacattaaatatagcctggtcttctcttaattctttttaaaattaatgtagatttctcaatcctttgatactttttcctgaacgcatcttatattctcatacatgttaatgtatggctacataggagaggattcttttacagctggactggaacagcttgatatttatatctagagatgcattggaaacataacactgacccgtgagcaagatgaaaatggcatgtgctagtgattcattaatatgttgctttaagtttagtgccaactggtctacatcgttgagaatgtttagtttgatggtttacacaacttgacttaagaagtgtatgaccaacagtgtatgagagagcctgctataaagacttttctgcacttcccttaaattattatagtaagctcaaatcttgaaggttcagaatatacagataaaatgtgtccgtgaggctgagaaaggatctttagggagaaaggctctgttcctgaaagacagactttcaatgatttcctgcattttatttctgttctagtttacctttacctttattaatcactaataaggtggttcttatagggcctcataggcctttttagttttccaacctattcatacttagtgcaaacctagtaattttttgcatgatagtattgggattttactctgaggctaggcttcacactgtaaaaacatctttttggaattgtatcattttcagtctttccatcgtgttccactgtcccagccacacacacaccagatatgaagactacaagcaacctcaaaaagtaacccatctatagtagatgtttttacctcttgtgaaatctaaggaaaatatactaaaaatgaaggcatcagtaaaacagtatcattttaggttgacctcgagcatttcaacatcagtctaacttcagaataatacattagcaaggagaaatggggtacttttgtggttttttacacctgttatttcaattgaaattgaaaaaaaaaactaatttgaactaaccataaaaggaaggttttatcagtattgaaataaaataacagaaaatgcatttgtgggtctgacctcaggaccgattttaaatagtcaatccctctaactctcattcccctttctctgagcattagctttattcttattccatcttacttgatgtggcactgacagatacagactcgttcttacaacatataccatcagaagtgaaaccttcacactctccaactcttgaaaaatctgagatgcactttgactattctcagattatgggtatattacttggatcaaaaagtactgcacagggaagtagatactgtaatctctgacattacagtttcaaggttggagtgagaaagggatagctccctaacaagggagtatcatagaaatgatattttcatggtcatacttctgtgaactaggcagacatcccttcatgtcaactacatctctactctactttgaacagataaatatccttgcatatacaaaattatgcagtagtgtaagcatgacttttcattaaaatttaagcaaaacagtctatttaggtgaatacatactgatacaggagatagttctgcttgaatgatctttacccttggggagagatacataaaagaatgtcatactttattatgatatgactatccagcatatttatgagtaaactttcataatacctttctctattgtctaaaataagcacaaaaacccttttagttaattaatatccctttttaatatacagaataaatagaaaatagcacaaaaggtattatgccagcacacagaaatagttccagttaaaagtcaatcctgtattttgagaacttgacaaaatcataattgaaaatagtgtactatcttacatgcagatgttgtgtaatcagggacatccaaatcaacttacatccaaatatttcacaattagtttttgaaatattctgtgaagtattataaaaccaggccctcaggaatataaaagcacaaagggagccaggactccaaatagccatttattcatttcctaaggttaggtacaatgaggactgcatttttaacattatcagggccatagagacattggagcttaaggataagatccaatttcatagcagtctgttaaagtttaagccagtctaatgacccaaatgttcaccataataattaccatcttgagtgatgatgttatgaatacaaaggaacactgcatctctaaaataaactacgtttatatgacatgagaccaatttgatggaaagaaggcaaaactgtgaatggtaattttgttttaattgttttcattgtgtgtactcatctgaaaatataataccatgtaattagaaaagttatcataacagaaaatagactggaaccttaactttttatatcaaatgttctgcacacgaatatggcctcctactgatgatctatggctccaaaatattggtagctataattatgctttgtaaaacagaagctgtgaatgtcttactacataaagacacaaagaatcatttccttactcattcactgctagtagaccctgaggcacagcatttcctgcccagatacctgattattaatccagtttttgttaggggtacactaacgttaactaacggagattggtgtttaaaccagttaatgtaaagaaatgctgtaggaactgaaatattccttttaaattaacaaaagtgttctttctagatagtcaaagttacatgaggacccaactgtataccagaaaatcatttgatgaatatggaattaataaaataatgttttgttgtatggttttagtactttgttggtgccaggttaaagacatgtggccctagataggataactctacagaagagaatttaatttgtttgcctgcttcactagaaatccaacaattaagtcagtgactctattttccaatattcatttcctccattttttcatctctttttgattgatggtatcatttcgttattttattttcattgacatggaattcattttggctaaaatgactttttgactatttgtgtatatatatatatatatatatatataattttaaaatcaatggaacaatattgtttctctacttccaagattatccctctatattctctaaagtcgataccgtgaaacagtccagatatgagtctaggaatggcagtacgaaatactgtaaaactggaagcaacttagtaggtaatcagtagggaaaatgaaactcaatataactgactctatttagttaatgtaatgatgcatttattttatatttttcatacaagtatttttttcatattttaaaatttcaaagttaagtatacatgtgactacagtcctcgcaacttctttaaggtactttatccggcagtcactagcagatgtgtttgtctaattcttagttttttttctgcctcataattttgttcacatttgctgtggagattttagaaatcacctagattgtttggtacaggaaggaaatcaaccctgggctgcctaattactgacaatctgtgtttctatggatacacatacattgatgattttggttaaccctttccacaaacagtcatacgtcccatgatagcttgctgtatattaaatcaaactttttatattgaaagtggataaagtaagccaaggtgttccagaagaaaatacatttggttctatatttttaaaaataagctatagcttgaaagtttcacctgcagtcctaacaagaaacaaattgggataaatagtccaaataaatgaaacacataaaaaaagaatctatatcaagtgtaataaattgtttacacctcaggtttttttctgctttgaaatttgtcttgacgtttgaccacatacatatttctgttgtattcacttctaaaaatagaacaggaaagatgtggacaacaaaaataggatatgaattgagagaagacgtgaactctcagaagaggagaagaatggcataaggataattagcatcgagatattgaatctcaacaaactaggacatggtggtgtagataatgatgaaagcatgcttgatatgtaaactagtaatttggtcgagcgagtaattttgacattcagatcaaatacaaataatttaataaaattagaccacaaactgcatagtgtgctcacataattgttttcattttttccttgctccgaattcaggtctgacagaggaacagataatacaaataacagttgatcccttacatcatctagctagacaaaatgatgcatatatactaccaccaatggaagttttcttcttttccttatatctttaatcttatttttaaattttatctatttcaatttataccttttatttttttttattacctaaaatgtgctatatgaataactttcagggaagcttggattaatgctgcatttgttcaatatgtgacattttccagttcctccataatattctagttaagtgtgtatggcccattaacctcctcctttgtgtttcagtgcacagacttctgtcattaatcatctgtacaactaaaaattcagttcttttttaaaactcacatcagactaaaactttagagatttgacaggcactggatacttttttattttcaaaagaataatcaaaatgtctcataactatcaaaatgaggcttagatggggaatatgtttaagacagactttgactaggggaaaaaaagagaaataacaaatccttgggtccaagtactccagtgacaagcttcaagtataaatgcaaatccttttagttgaatgagttacttattctagtttaagcagataatgctgatatcagacattttggtattatataattggtaggattaataattttatagaaaattggctcatttatctttgggatagcatgagatattaaaattaactctagaaaagagaaaataattttacttcaatatttccagtacatcttttggggcgtttcattttttaaggtacgtttttggaactacctgtaagcatatgataacaatatcagcacactagcaaacacactgttaaattttgtgaaaagacttattggcttatggattcagacatttacaaggttactatatccctcactaagaaagcataattaatttatcactgaatagatagactagttggcttttttttgaaagcccagagattatattaatttagagaatgaatataaaattgctttgcattttattgctatgggaataatttaaattgcttagtgactttttgctattttgattttgtggtggtggtggttgctgttaaattctttcattctagccatattttctcctcccaatttttcattcatttattaataatacatttattaattcatttattcattattcattatgtgaggaaacattgagttggaccacctgatgtagatataaaaacgaattaaatttttcttgccatcaagcataattgaggcagacataaaaatatttgacaaatattataattgttatagttgaagtcactattaaataacaaagtagcacagtttgagcttaaactccacctggagagtagaggaaggcttcatagaagtagggcatgaactggactttgaaggttgagaaggctcacttaagaaggctgcggggttggcagtcatatacaaagcctcagaaaggtataaccacatggagtaattgcagaaattgacataatttaatattgctttgaaattgcatagaagtggttacatataaaactggatatgtcagaacgagggtcaggtccatatgttcagctgaagaggtttcacattgtttcttgagaaatggggagtcatttcaaaaaagaggaatcatataaatagatttctgtactagtgaaattatccaagaaacagtgaagatgactgagttcatagtcaaaactggagtcagagagataacagaataattcaataaggtatatatgggaggaggagagtcgatttaacacaggcagagtgtaaatgatgagcaaagaataaatataagaaatcatataaatttcagagattatgaacctgaagtcagtatacatataggagaaatagaagtggtggatgcatgagaagtagtagttttgacaaagatcaattttctatgaaagaaaaggtacagtgcacattttgccttaaagtagctgagggtccttcaggtagagatattcagcgttgactaaaatatacagcaaaattctagaagaaaggtaatagaactaacaagattctatgctacaggtatagcattagcaattttcaatgcacagttagcagtcaaactctacccacttttcagtaactatattgtatttaactagaaatgatttttttgagaaatagattttcaataaaagttatctttagctaagaaaaagtgaaggaaagagtgggtatctagaatctaaagaaaaaagtattattcctctatggaataatttttctttctgtcaagcaacagttgagtaatgggagttatattgtccctcagggaccaaaactggctacgtaaaataataataagattatactcttaggtataaagtatggatataaatatagtaaataaatacacagtataactgtggcattaaaatttaatggaaggcaatgacttggaaaaagaaaagttcatgaatgctcctaggaaaaggtaaaaaatgaagttgagaaacattaatctgatagagggatgtgtcttcctttttttagtgaaggtatttctgagtgtaaggtatttttagtgaaggtaaaatttttagtgaaggtatttcgtatgtaatttgtgaaatcagctctcatactaaaagtgacttaatgatcacaaaatcacaaagactagtgatcttcctctcttaacattcttacatcaagttcacagtctgacattctgacatagtctgcccgctcagttgctgtggagttgaactcctctgtcgagtccatatccctaagggatcataagcttttatttctgagtaaggcagaaacttattgccaagataattagtgttagttattggaagatcattaatggcatcagcatcaaaaatcgctccaagtgggagagcttcctttctcttatggagttttcatttaataagccatgcttccacttaacgtgaccaaagaaatcggttgtattttataaattttttttagaatgtatgtacattcaaagtgagcatagatcttatacagaggatatttttaattgtatattaaaggtttttttcttagcacatatagtcttctgcataaagaagccaagaagaaactataatgataagacttctctggtactatcacataaataatgagttgtaaacaagcttaaaaaatacatacatatgatatagaatatataggcatgcactacttaactaaggggatacattctaaaaatagtgccattcaacatggtgaaaccctgtctctatttctaaaaatacaaaaattagctgggtgtggtggagcacgcctgtagtcccagctactccagaggctgaggcaggagaatcgcttgaacccatgaggcagaggatgcagtgagccgagatcgtgccactgcactccagcctggctgcagagcgagactccatctcaaaaaataaataagggctcagcgcggtggctcacgcctgtaatcccagcactttgggaggccgaggcaggcggatcacgaggtcaggagatgaagaccatcctggctaacatggtgaaaccccgtctctactgaaaatacaaaaaaattaatcaggtgtggtggcgggtgactgtagttccagctactggggaggctgaggcaggagaatggcatgaacccaggaggcggagcttgcagtgagccgagatcgcgccactgcactccagcctgggcgacagagcaagactgtctcaaaaataaataataaataaaataaatatacataaataaaaattaaaaaagtgccattaggtgattttgtcattatgcaaccatcattgggtatatttatacaaacctaaatggtatagcctactacatacctaggctacatggcataacctattccccttgactacaaacctgtgcaacatgttactgaactcaatacagtaggcaattttaacacagtggtatttgtgtatctgaacatatttaaacatagaaaaggtacctaaaaatacactattataatcttatcagaccactgttgtatatgcagtctgtcattgagactgaaaagtcattatgtggtgcatgactctattgtttaaaataagcaagtggcttctctgcctaacctatgcatgatggaaggtcatgagatttgtaatctaattcctctcatgcagagagtcactttggatagataagagcagcctaaaccctagctgaggttaagtgcaaatgggtttgcacctttaatttctaaattctagcaagcaaaattgtttaaagtatgtggaattaacagtctgactttaagttgtacttttcctgaattattttatcaacaaatgaatttaaggatttttaaaaagtatcaattgactgtgactcagtaaaattccatccaagaaagtcaatttctttctttcagtcttatgcgttcactagagatctagatctggggtagaaaacgtaaggttttcctttctaacattttactttcttacatgaaaaaagttttaacttagggtccataaattgctgctgcaagcaagggtctgttcagctgcaaaagtggtagaaaaaatatgaatgtgtattcttttgtttacttttccccctttaggagagatttttcaaaggagttcttgactcgcaagcattaacatttatctggtgctttttcggttcactcttccttttgtgtttggagggagctagtatcattctttatttggcaggagacagaaaagtcacctccatcacacgtttttatggttcccctttagccaggtttatgcttactgcagtgacagccaatttctctttcttagcacaggaagaggcaagctgacttgtgttggcttgctctctctccacatacacttctctcctcattgtgcctggacaatactaaagtctgtttgacaaggccaggaagtctcacataatctaacaaattatgtataatttttaaataaatttgatattaatcataaatgtttcatgctgcaggcattacaatgaatttcactagaatattggtaatggaagagctgaaacatctattgtgccactttgtttttttcttaagtgtaaattaatagaattatttaatgacactattggaagtgattatgaaaaaaaaacacaagagataaaccatgagacaagaacgttattcctttgcatatttcagtacagaccgacatgcagtaataccttaaaaatctgataataaataaaaccagaaaacattggcagcaatcttctttggggaagaagaaaggatttacttttgccatagggtataatacatttacatcataataacaccatacctgtgtcttttataacctagagaattgaactcttacatgatgtcactttttaataataaatgcaggaagttcaccttgagagtaaatagtagctagagctcagtaaattaactgaaggaagagaaaaaaacatatgaatagacaacagaatgttttcccttgaggaggagagcaatagaatattcacagaaaagcaattactgtgaaacatagtaaggtatgcagaaaaagtgaaaggaaagttaatgagtttaatagaaagatggcaataagaaaaataggttattaaattgttaaacttatcagtaaatacatatctatatgtaacatctgtagatcatctgcctgactgcatttatatgcacaacttaccacttttgctcgattgtaaactacatgagaacagaatctgtaatacattcattttaaaataactgacatttcctgttagaatgcctatcccggagttcagatctcagaaacacattctgtaactagggtctatccgaacctccagatccaacacgtataaattgcctgagaatatttcctgatctaggtctaggttgtcacttagaggttctcttgaacttaaaaatccagctcagaaaagatttccatatgtctttccccatgtttctctgtgttcaaacatctgagtcccaaaggctaatgatcattcaaatagaaacacaaaacaagagccttagcaaaaagtataatttctaaaccatgctgcagcaaagattccctggtaaatgtgatatttaaggaaataagtctaaacctttacctaatctaaatttcaatggcatatcatttttgccatcataaaggcaaatgctttgctagtttggtttaatttcttaaagtattgccttaatgttacaggacaccaacacttacccaaaggtggccattgggttagggtttctgcattatagtcccttctgtagtcaccagaaatatgttacaggaatagggttccaatccagaccccacgagagggttcttggatctcatgcaagaaactattcagggtaagttcaaagtgaaagcaagtttattaagaaagtaatggaataaaagaatggatactctataggcagagcagccctgagggctgctggttgcccttttttacggttatttcttgatgatatgctaaaaagcggtggattattcatgtctcccgtttttagaacatgtagggtaacttcctgatgttgcaatgacatttgtaaactgtcatggtgctggtgggagtgtagcagtgagtacgaccagaggtcactgtcatcgccattttgggttttggtgggttttgtctggcttctttattgcaacctgtatcatcagcaaggatttatgacctgtattttgtgccaacctcttatgtcatcctgtgatgtagaatgccttaactgtctgggaatgcacccagtaggtttcagcctcattttacacagctcctattcaagatggagttgtccttgtttatgtgcctctgatattaatgctgtgccttaaactattattgcaagaaatcaagaggatgttaatattcttttcagcatgactaatccttagacaggattcttcttattctaggcctctgacctctcttttcttagaacgtttacattggaacacttcccattccatattatctctttgcccctttgagatataaatcttgttaaaagcatcttaccagtttagaatttaggaatgtcttcctaaagaatctgggaaccatctctttgaaatgtaaatatttgaggagatagcaccccagtttccaatttccttgggagggcagactcctaacatcaatgagtaccaattagctaacacagatgacataatctcaaagaaaaacattttgaaaactcaggaataactaaatatgctccatacatcccacagatcagcctcccttctaacatcttgcaagacattttcactggcttaccctagtatataaaaactctcccacttcttgtttcatctgagttgagttcacagtgagttctggcctttaacatctactgcaatggctttgaataaagtattcctttcctatttaactttatccagtgcaatttttgatttgacaatagttatcaaaaaagtagtcatatcaaattgatgtttcatttaccctgtagttgttataaaatctattacctgtggactttgtttttgctgttttgagatagagtttcactctgtcacccaggctggagtgcagtggagtgatcttggctcactgcaacctctgcctcctgggctcaagccatgctcccaccttagtgtcttggactacaggtgtatgccaccatgcctgctaatttttgaattttttgtagagatggggtctctccatgttgcccagactggtctcgaactcctgaactccagcagtccaccagcattggcctcccaaagtgctgggattatgggcatgagtcactaacttgtcctattacttgttttgtgattgagggtctctgtgttacaggattctctccttagttcagttaaagatgggatccttgtcacatagccatgaaaaattagtcttgcagacaattcaaagggtgaggaaaatgggatttattgggaaaaaagggaaaaaggaagcctccacaaacccagagtccctgctgttcacttcctgccttgcagattgaataccaggttctgcccaggaagaggaggagcctggctcctctctgctgcaaatggctcagacttcctgaggctctaccacagtgcacaccaatcccagtgtgtgggctggtgggggtttgtcgaaaacacctttgtaccagctgtttcatgagaaatgtctttcataggatgatcacaaaaaatgttattttttattgttttttcaatggataaactttatgttgttgagttattgatgatatattgaaatggacttttcattaccagtgaggaaaaagtggcttccctttaccttcctagattatttcattagactacaaattaaatgatcataaaacagattaccaacaaaaaaactatagttaactatgtacatgcacaggagtccaacagaaatatgagattcaatgaaaagccagatgattgatgcttacatagcattctgagctatagagaaatatttgaggcttggggttagtgaaggatggtgaagacaagttataagggtgagggggtggagatgtatggtaaataaatgttgtcttgttctgcagatcaaaaataggtaataaaattgtctcagaggagctatcttcctgtattggacatctgtattaagtacttttactaaagcagtgaagaggcaaggagaaaacttccccttcacccttggaaggctcactgaaaattcaactctcaaaagaaagattaataagagaaaagccatctcatttattaaggtgcacatggagagatccggagtgattacccaaacccctagtggggtatagaagcttatataccaccatgaggttacagatagaatggggactcagagcccaggcaaaaataggttatgttggtaaatcaggttatagcagtaaggcaggttatggatagaagagaagcggaggcttggctagcaaaggtgaccttgtaatgtaaatgaaaccttgcatgtagctgccctcagataaaatagatggcatatatttctttcaggcctttaaagctgtcagactctcagttactctttgctagatccaggaaagggaagtcctggctgcatcaatgcagattgtccacagatgcaaatctctgccacaaaagatagctttgtaaggctacatctgtttgctggctctctgaacagccatctccatgtatgccaaataaccatattttggggtatgatactgttcgggtctgtgtcccaacgcaaatctcatcttgaattgtaatccccacgcgttgagggagggacctggctggaggtgatcaaatcatggtgaggtttcccccatccagttcttgtgatagtgagggagttctcatgagatctgatggcttaaaagtatgtggcagtttcccccttgctgtctgtttttcttcccccttgcgaagaagaaggtgcttgctttctccttcaccttccaccatgattgtaaatttcctgaggcctcccaaggcatgcagaactgtgagtcaattaaaactctcttctttataaataacccaatctcaggcagttctttatagcactgtaaaaacaaactagtacagcataaaatatttttttcttcagtagattttctttatagattacaaaaggacaattttcagagctactccttttctgcagtttctcaggataaccagctgaaaatataccaaaagaatctactttgcagtggcacattctgctctccaacagtcatatgagagttaggctcagatgtatcctgagccctaagagtgccaaatcactggtacaaaccaaaagtaaaattgtaaatcccctcagccatctgcatagaccacctcctctccgtcaagagcattccaaagttaacctgaaaagctagttgaggccatgatgggaatgggaaacaagccatgtctcattatactctcctctgttttggaattgctgatagaacagactctgagtctgataggaaacatttacaatctattctctgaaacctgctacctggaggtttcgtctgcataataaaaccttggtctctacaaccctttaacttaatccagacaattcctttccattgattctgagtctgtataatggcttaactcttcctaccaattgccaatcagaaaatctttgagtctaactgtgacttggaagccagtttcatgcctttctggagtgaaccaatgtggagtacaggagaaggtcagagagactttgcttccgaggcttccatttcctttatttcaaagtactcagcatgcccaagtgccatactttggggtatggttttctgagccctaacaagagtaaaatctgtacatgaggtaacagtgtgctagagacacagtgagaaatagctttgttaatggggtagctatttgaataaggcgtcttttcctaggatctgtcaattctcaaggacagctttaggaaatatgtgtctcctcccaaactaacatggagattttgtgatgtttatgtattttcctgggcaagaagtttttctatttaagtcagttctcaatggattaaatcttcaaactcttaaggccaaacccatttaaattaatagaagagcatctcttttgttggaccagagtgatttttcagctattccaatagtgatatagaggtagtatgtttagacattcctctgggcatgcacagctttctggtaagttcaggcccatcatctaaatatcatacttaaaaacataaatgggccgggcgcggtggctcacgcctgtaatcccagcactttgggaggccgaggtgggcgggacacaaggtcaggagatagagaccatcctggctaacacggtgaaaccccgtctctactaaaaaatacaaaaaattagccgggtgtggtggcaggcacctgtagtcccagctacttgggaggctgaggcaggagaatggtgtgaacctgggaggtggagcttacagtgagccaagatagcatcactgaactccagcctgggcgacagagcaagactccgtctcaaaaaaataaatacataaaataaaataaaaaataaaaaacataaatggaacaaaaatgattttattaaacaggggtcttccatttacattagccaatgttgctttcctcaaattgtgcacaatacccacagtgttgctaagagtgacagagattaatggaatcaaaaattatctctcactcatgcaggtgcaagttagatttcaaattgtatggccatttgctttgttctagggaaaactctttctttagtaatagcattctactttctatggtaattgagctttccaaaagcaaactgcttcttcaattatgtttccatgaatgaaatttttgcagaatatatgaagagttctgtttctttaaacactttaaaacattagtttacttttttatatactgcacaagtgcaatgaaatgaactcattgactattatttaactgtgatgctgaaagctaaaatattgcattgcaagagcttttagtgatcatcatttagcattttaaaggtactaaaagcactattcatccatcaaattgttcatttgtttaaaacacgtgcaacaaaagctgagtgtacctaaaagcacaaaataaatctgctcccttgcactttagttagatgaagcagaatgtgcacaggtaaggtcagtaaaaacacatacacacacgcacaaacacacacacacaaacacagtatgtttgtactccaagaagttcaataacagttgaatgcacattcataacacatctttggaaaacacatgaatatacttttaaatcctgaaacaataaaaaagagaattgtcacaagattggtttggattttagtatcattctattagaagtaaacttcataatcattttaagaactgcaatcatctgttttactttgcatttctttcctttccttgtttccctctgtctgcttctgggctattagagtttctcaaattgtttgtatcacatagatacccacgtaaatgctgcagggttaactccaagacactgttagacacaagtgtgcttgtatttcaattcttgtaattataagtggccccacttcagactattctgttctatgaaacacaacggaaagcatcaaattaggggaaaagagtggctcagactgccccaagcaattaattaaagaaaattactactggatgctttatgcacagcaggggctctgtgcatgaagaaatataactgctagtcacacctgtgctgattctcactgtggaattgaaattatcatgagtaaatgtaattacttagcaaatttaataaatgttgtttggggttctgaaaacagcacttggatctacaaattacacagtgataagtgtggcagcacaagttcagtggtctctaatagcactaaaatatgtagagcatcctggaatgtaccaggaaagcttatgagtaagtaaaggtaataaattgctacaaaaaaatgggtactaagccactcatagttacccatgctttcatgttttcctttgattatgtaattttgacaaagttatttttttcaaaatccccagtagtttagatatccaagcttatcctcctgaaatacaaataagtttattcctaacaaaaaatgagttagtatttggtaacgcttgaaatgaagtgctctaaataagtatttaattaagaataaaacagctattgctcttgggttgtgatgattggcaataattgctttacatgatttaatggttataaaattaacaagagataagtaataaaaataagaaattaagctacatttttcatcataactttaatttgtatgctcttaagaatcataatgatgattggtcttttattaaatgaatattaagatgaaccttcatataatctatattatctttgaagaatatgttaatcattaagtcataatttataattaaaatgcaatacaatttattttgtcaaaaggaaataaagtatttgtgtattttgtaaaattgccatatggtaaaagcctattcagagtataagccttctgctataatactaatagccataagtcttctactttaaatcaagaaaatgttagaaaatgtttaatagctttagtatatttaaacaattcatcaaaattatttaaaattttgctagggctgtcataacaacatgccacaattgggtgatcaaaagtcacagatacatattctctcacagttctggagactacaaatccaaaatcaagctttctgtgggaccatgatctccacaaagactctgggaattaatgcctccttgatcttctcccttctggcgtttgctgtcaaatttcagcattccttgttttgtagacctggcactgaaatctctactttctttatcacatggtcctctcccttgtgtcttcatgtcttcatgtcttcacatcatcttccttctctgtatattcacatcatctttcatctgtgtatgttcctatgtccaaatttctcccttattagggaaaggaatttatctagtatccaatgtcttaagttcaataatggattttgtggctgcactagtttaagatggctatatgtgaacttgattacagctataagaatcctatttccaaataaggttacattcgcaggttctgggtgggcatgagttttcaggggccactaattaaccgagtacaaatataaggtgttaatgttcttgtaagtcgtgtggctgacttctccctgttttgtcagtgccctgcaataaatacaattcccacttagtatgcacctatacacaaaaaagaatatttattatgctctaatggaggaatcagggtcagaacacttattctgtgaccagataatacatattttaggctttgcagaccgcatggtctttgttacaattgctcacccgtgctgtaaacaataggtaaatggattggaatagttggatttggcccccagtcatgattttgcctacctttcctatggtggaaaggaattctttattttgtttaacagagtaaatttaaatatctatatcaaggaaaatctgttctttgaaagcattgtccacaatttttcaaaacccagattttatttttaaagctatttcaagacctaggaaacataatgcattttaaaaatcaaacccatatgaacaattaagcctagagaaaagaaatacatatatttggggtgaattgtaaattcagacacaaagcccttctgagtgtgggaccccatgtgacttcacagatcatatgcccttgacattaattctgtctgaaagtatttttgaaatcttgttctttcaacacactaggtcctactaaatgggatttttataaagtcactagtaataactcacaaatggatcaaatgaataatatattacttaaagtgcctattataatgttttgcacattaagtgttgtcccagtacagaggtttttagatgtatttacacttttaataatataaatatcaagtggtgagtattgccccaatataaggttattttaaatgtgatttattatataattaacaatattactcttataatcatagtaatattttagtcaaatatcaacaaataaggtgctattgctttatgagtgttttgtagaaatagtcaaaagttctagctatgaatcctgaaaagtcaacacttagtgaaaactttggttcactaaaaaattatacaaccaattttgtgaaattactgttgcaagtctcattcatttaagtgtgattaacaaaggaggttaaatttcacatagcataaactttttctgtttttttatttttagtgtgagaactttctctaggaataaaaaaaaaccctcatgttattttcgttttaaatgtataacctttggcacaaaactgagaaaatggctgcttcactagatgtgaaactgcctttcccttgcaagggttaattactaaagaagaaattcaaacttaaacaacaaactctgcaatcttaattaaaaagaaactatcaactggtgactccgggtagtttagagatgacaagtatcaaatatgtggtaaagtgaaatgtaaaaagtaggagaaggtgattataaggcaggtcagcttttagatttgccatagcagagatagaaatactacgactgattttaaaatctgtatgttgaactttacctaatgagttttatgtggaggcagatgaatagagtacagaacacaaaaactacatttgcgtaatggaatatggttctgcttaactggcaagagaaaattattttttaaccattaatgcaaatatctactgtttcattttatgttatctgattattttaaataatgtgtctgagtagcaaatagaaggcttttttccaacaaaagatcattatatcatttcatttttccaattctgtataaatgtccaagttagttttttttgaggtcttgcaaacaaaatagacattcaaatattcagattttaatttttcttaaattaattttgttatttaaacaatgtaaaatcttataccacttgatatatgttgataatccataattccatttgatggcacaataaaaatcacatttgtgttttaaattttaaaaagcaggatttatttttaaactaaaaatttagactctcttagaataaattacacagtctcaaaatactattgcactctgctacaagtgaaaagcaaaattttttttattaaagaagttcaatcttagtgaaataatttacaataacctagtagggatggtgtttaagagattgaagcaacataattcacttgattctgatacatacatacaaaattttctaacagttacttttaaatacattggctctgaaagttcattttaattctttattctgagtataatacttttattacaattttaaacttaattttataaagacttttctgaagtataattttaacccctcatatattttctaaacaattgaacagaatatttatagattgaaattttaggcttaaaacagaccctcttaatattccaatcttttttgagtctaagcccacgttccctgatctaacagataactttaagaaaatgatattaattcatgtcaaacaggatttctgtctttgagagaatcacttactttcctcaaagttatttttgaccatctattgtgcttaatatgagatggttattgagttacttgataaacttgtagtttccatacataaaagtataaccattctgaatatcaaatacttcatgataataaaattataatttacatctatattttactttgtctattcaaaaaatgtttagaaaaagtacatggagactgtagtcagcatattatttcaaaattaatactaatgttaatgtatgttgaatacctgtgatgataataactgtacattctgaaaaaaatgttactatcctgtatctaattgctaagtaaatcactcaccatttttaagcacttattatatgccatgcagtgtgatatgttgtgaaaggatgtataaggtgacacaaggttctatcattaaagacatgaggaataaacttatcacaataaatgatatctaatggcttaaaaaagaaagaaaatattctgactgtgttattagagtttcaggctggggaaacagtcacaatgatgatgactaatagatcatttaggccttaaacataaatagaactttattaagcatatagaggaaggggaaacaaatctatgtaaacgaaatagtatgaagagaagcatagaagataaaaatttaaaaatacaagaaattttaggaaatttttaataaccaacctagaaaacaacttgagattcttccttatttttaatttcatttatacaccatcattaaccttgctgagtcttcctccaaaatgcctcttaattttattacttcatttctatttgtgttacttgctgaataaagtttcacgtcatcatgatcagggattcctgcctaagggtgattttcatgcgtgaaggatatttggcagtgtgtgaagacattttttattatcgcaagtgggggaagagcactagtagtatgtagcaggtagaggccaagtatattggctaaattgtagccaatactaatacactgaagaatatgctaaatattctacaatgcctaggtcaagttcccataacaaagaattatctgtccaaaatgtcaaagtaccaaactagcaataacttcctaactttatctccgccttagaaattcctattcttgattagaaatcatctagtcatgtaatgaatttgatctactataaaatatccaagaagagatatctatgagacagttaaaaatctaatgttaggcatcaacagggaaatcatttttggagatacaaattagtgagaaagtataaaggttcaaaatacagagatggttaacattttctagagaaaatctttaaaaggaaagaaaaaataataagataataaaatatttatatttaaaaggaggatgggctgggcgcggtggctcatgcctgtaatcccagcactttgggaaggaggccgaggcaggcaaatcgcctgaggtcaggagttcaaaaccagtctggccaacatggtgcaaccccatctctactaaaaatacaaaaattagctgggtgtggtggtgcatacctatagtcccagctacttgggagcttgaggcaggagaattgctttaacccagtaggcagaggttgcagtgagccaagaaagaaccactgcactccagcctgggcaagaaagtgagactccatctcaaaaaggaaaaaaaaaaaaacaaacagaagaatgaggatgtatctgccaacaaaatattgaacaaacaactgaaacagaaacattaagaaaggggaagaagagaacatctcttaataaagcacatgggttcagctactgaccacttccatgaatttggctgtcttcaacatgcctttaggattagtaataattccactttttccaaatatatgtttgttatctacacatacattagatattgtttcttatattgttaacccttgtatttattctcatttggtaaagtagtacaaccaacagagaataaaacaagttatttcaaaatgtaaaaatctggggggtcacaggatagaaggcaggagcacatcagtgggcacaaaatcccagatgaataccaaccatttctcagcttttggccccttcaatccactgcatgatgcaccaaggatgttcaggaaagtaaaatagcactctttcatcaatcatttctaaggcatctgtaaaatgctgccgttttcagggaagaggggctttttcccttacctgaaatgaaaatcagcttaacagaaattgagcttaaacatttacccaactcagtaattttggcatttgtgaattacctgatgaatacatacttgtttcttatctagaaattaaaaaatcttacagtggttttgtatggtgaaaaatctatttctatcattgacccaagtattcccagtaaggaaagaaaagcttttattgtattagatcctgcttgcattaaaattatctttaaatattttgacttcatctatttgttaaaactatcaaatagcttacttagcaaaatgaatatttaattcagaaaagaaaataaagcaattactgtgtgtatattcagccatatacgtagaaggtgccaacttaattgcttagaggggaagtctttctttttcattctatggtcacattcccttttaaattcatatgtgtgtatgtgtgtgtgtgtgtctgtgtataatttatatataattgatgtacaaatatatatgacataaatatatataaatatatgttatacataatatataacaatattatttatgacataaatatttgtatttacttatttgtcaaacatttagtgactgtcaacaatatgcaaggtgctaagcatgccactatgttaacaactataaaaaagccaaagaagctttgagcttggaatctgaaaggagagacagaaatcaaagtttatttctgtctacagaattagtttattaaatattaataaatgatgtttgagaaaattataagttgctatgaaagcataaaccacaggatatgacaagtctagagattttgataaagctttgtagggagaatttgaatgaatcaaactaagaatttatgaagattgagctggtaaggaaaagggataaattcattctaggaagaaaaggaacagcagaatgtccttaggaagaagtgagcatgaattatttgctaaaagtggaaaatgctaggaaattacatggagtgcaaattacacacccaagtagagatgtgaaagtgcataggaaaagatgcagcatttaatatgcatttaaagtttattattaatagcttgaaaataaatacatgaatgaatggatgaagaaaagatttagcagaagattatttactatcaagaggagcagaaaatacttattagacaaaagtgaaaaatgcacagaaaattgagttacttgccaaaggtcatctggaaacatcaaggaaagaattaaaacaaagtggaaaagaagcacaagcttatagaaattatgttgagaccagaggctatttatttttaaaattggaacacttttttctgaacttacaatacatttaaattgattggaaatattattcatacacatatctaagtcaaatatataatctacctaatggtttctggcatgtattttcctttcagtcttttcttcagcacataccatgaaaatacatgagatagaagggatttttaaaaagagacctagagattgtggggctacattattcagaataaataaaagcgaaatgaaatctaatttaaaaacatatcacaagatctaacttactgttatatacacaaagtgcattttagtagacaatatacagacaatgtttcttttaaatcaacatttgttgacaatgttatccattatccactattattcttattagttgtgtcttatttttattaatttttttttctattggattttttatgagagatttgtttggttataagattttaaatgtggctattatgtcagaatacatatctcaattcaaatgaaatctttttccaagtttacaatcaactgtgtccttccgtaatttaatttgttgaaaataggaagcatactggtagtacattttagtaattttaaaatcctttagtaaaggaaaaattacattttggctttgagaaatatcatcttcaagaataaaaacactctttcatattcatgtattcatagagcataaggtattcactctatagtacgtttttagatttgcaaatatttttgagtagaacataaaagaaatatctaacttcctaatatcaaggatggtgtgaacatcagaaagctacctttgttatcctaaaacaacttaggttttgttgagaaaatataattaaaaacagtcttattccaatcttgaaaacctctctacagaggtagaagagaaaaaaaaaagcaattttattattgaataagcatgaaaccaggatgtgatgcacatcacaggcaatccactaaagagaatgcagacagaaaggaatctcacccttttatatagccaaacagatgcaacctattgtatacaccttttcattgttgtgagataatcataggatgtaatggacttacacaaaattggatgttcttatagcacagaggctatatggtatagcctattgctcctaggctacaaatctgtacattttaccaattactgtaggcaactataacacaatagtatttgtgtatctaactgtatctaaatatagaaaaagtacatgaaaaatacattataatcttatgagaccgccatcgtaacatgatccattgttgaacaaaatgttgtgatgcagcacatgaatatgtaggccttttagtaattattcaatcttcctaaatagcttttttcagttttgcaactcagtagcatccatggccatcatctaatataaaagtcttggccgggcacagtggctcatgcctgtgatcccagcactttgagaggccgagacgggtggatcatgaggtcaggagttcgagacagcctggccaacatggtgaaaccccgtctctactaaaaatacaaaaattagctgagcgtggtggcaggggcctgtaatcccagctgcttgggaggccgaggcaggagaatcgctggaacctgggaggcagaggttgcagtgaaccgagatcatgccattgcactccaacctgggtgacaagagcaagactctgtcacaaaaaaaagtcttattataaggtacaaactgaaaggcaccgattaaactttgagtgtttaatgtatatagctattattattttaagtcttgaagacaaacctctagcctataggtattttttttcccagcgtgggatctaaaccaatagctctacattataatagtcaacaaaatattcatgagtaacagaaatttagtttcatgtatcaatctatacttaggtgggagagaagttacatcacaaagttaattaagtaacaatagacctgttttttgtggtcgctatcttacaatgccaagtttctatttttctattaactggaatgtttgttttcaattaagccaattaattgtttttgtttgttttacaagtagagcttgtcttagtccattgtgtgttgagatagcagaatactaagatggggtaatttaagaagaaaactttttcttacatttctggagactgggaagtctaaggttgaggagctacatctggagaggtcatcttgccatatcataacatggcagaaagcaccatatggctcagatttctcttccctttcttaaaaggccactaatctcatcacgggggccctattcttatgacatcatctatcactacatcccaaagaccctgcctccaaatagcaacaacacataaatttgggaatttaatttctgacacatggaatttggggacacattcaaaccatagctaggcttgaatacttggatgcatattagttttattttattatcaacaattataaagaagatggtgtcacttttactctgccaataataaaactgttggttatacaattccaggtcctgtttctgctgggaggacaatttgaactaactggaaaggacatcatgagaaccattactgggagtacagaaagaaaaggtcatgtaacaaataagttttgattcctagtaaaatgtgattcttaaagtagtcaaaataatccactggaaataagacagtaagaccatctaaaatgtaatatgtaaatatgttctctagagtacctcttcatctgaattcagtaccaagatcagttactcttgaaaacttaaatttcaaggccttgtgagaaccacagtcaagtcttgcccaggtgctgtctccgtgtgggaagcatgactccagctgagttgtttctcttttgttttggttttggtttttgttttattttgttttaatctctgatagccaaacgagtgatcagcagcactcgaaagccttctttccagcatggtgactgtattttctttctggaatacctttttgtagatgaaatttcctggtccacagagatagccaatttccactggtgtgtccttccagatcctattgtctttaagttttagggtttctagggaagatataaacccttttaggcattggaaatggttagaagaggatttgcttatatcaggcacaggatgtgctcttagacccaaattcatggacctgccaaatgtaggttcaaagagaagattctgtgcttgaatgcagaggcagcaggaaaaagactaatgataaaactctggagattttaacccagtacatagctgaatcttagctaattattttttaaaatttgatttatctactttatttatctggaggactgaggaatataaggtgtatgctacattatggaaatcagcacacgtttgcataaatcctaggcaatggtacagataaaataactttctctgtctgattcaaatactgtggtatcccaaaagttagaactaaggcttttaagagagtgtttaccattgcctgaaaatcagtttttatgttttgtttcttttttttttgaagagggtaaggcctcaggccatccagacatcatacacacagtaaacagacaaagctcttaccttttacatgtagttctatggaactcaactaccaaaaggctcctggtagttactcagagagcatttcctgtggtttcttaggagtagcatgtaaataattctgctgatgaatatcacatctctctaatatgtttgtattaaaaaaatcttttttggtgtgcaggctcagagtctagtgactttaaaaatcattttttcttgagatgatttgttgatgacataagaaccctaaccaagctgggcacggtggctcaagcctgtaatcccagcacttggggaggctgaggtaggtggatcacgaggtcaggagattgagaccatcctggcttccatggtgaaatcccatctctactaaaaatatgaaaaattagccaggcatggtggaagaagccaggaattcaggttctgggactttttaaaattttgacatgtatattgaatattcaagtggaatgcaaataggagttggaaagtcagaaaagtgttctgagatggagatgtaaatatgtgagttactggcttttcaagagtgtttagagcatggtaatgagtgaggtcatcaaaagcagtagcatgaatacacaagagatgtctaaggcctgatacctggaatactccaatgtaaagagcttggggagaagcagagaaactaccaaaggagattgagatagtgttgcaaataaaacagaagaaaaatcaaaagccatgtgatacccagctctaggaagcacaaatggtaattttgtgcaaatcaaaaatgtgtcctttcctcatggcacagtactgccatctgctggaatatgtttctaaaaactgtattaagattataatgcccccaaggtaaatgtccttcagtgcttagctgtaagcagtagagaaagtgtatgaaggtggaggaagtatatcaaatgtttctgatctgtttaaggcttatgagtattgaaaaacaattaatggatttagcaacattaagtatgtggtgacgttgacaaatgtcggtttgaagtcatgaaaatgaaagtttagttactgttgagtttaaaagaaaatgaaaaaaaattgtacacattattttcattttcttttaaacctacagtaactaaacttccattttcatgacttcaaaatgacatttgttatggtcaccaaataatctgtacaacaaacccccatgacacaagtttacctatataacaaactgcacatatgtccctgaacttaaaataaaagttaaaaaaaagaaataactgtagatagtgacaatggaccattctatcaagaaattttgttggaataagaggcagagaaataggttagtctgtagttgacatggaagttgcttcaaggaagtagggtggaaaaattggtaatgaaggagaaataagaaaaattaagaccacagcagtctgtagtagatgagagagaataagatctaaggcactaatgaaggaattgtctgtagagagacagaaatatatagttcatgcacaggagatggtgaaaaacagagtatgtgagtagtggctctaggtgggcagatatggtaattagagtccatagacactttcttcttttcacagtatagtaagaagcaaggtcagcaaaagcaagtagggatgaaaaaggagatgtgagagctctctggctagcatcttctcactttactattgctatgggaactgggagaatctcaaaagtatttacatacttcttggagaatacatttttctgatgaatatttatagcaccagcctaaacaaatattatttagtagaacatgcttgtttttaataatcttctttcctcacagtgttatctgttctactcatgtattgccaagtgaccatttcatctgaatattacccaacaggtttgcatccttctctgaccttggacagtggcatgtgtttctaacctggttttcttctccattaatgaaacacattattatttaatttccaaactctgtcaaataaatgtgtgaaaatatattcatgtgataaaaataatcactgataatttgtaatacatttgtagaagtgtgacttgtacctcatttgtgtgctgacgtctagtgcagatctcagagtcaggccaactctccattgtcctcactatcctacttgtcttagtctgttttctgatggttataacaaaatattttgtactgggtaacttagattgacaatacatttatttctaacagttatggggactgagcattccaaggttaagggctacatcttgtgagggctttcttgctgatgggaactctgtacggacttctgagccagcacagggaatcacatgatgaaaatgccacatatgataacatgcggtgctcaagtctctctccctcttctgataaaaacaccagtttctttcccatgaaaaccaattaattaattaactatttaaatacaccaaactatgaatgggctatttcatgaggccagagccctcttaaaggcctcatgtctcaatactgccacgttagggattacatttcaacatgagatttggaggggaccaaccattgcacttcacttccccattttgtgaccaaggccttcagactacaaagtagctatttaattctatgtttttgacattgtcccatgcctgccttttagtcgaagaggtatagtttccatggtttcaaacaatactaacagtcccaactatcttttctttataagatcaatatggaaaatttgatgaaataaatgaaaaaaactgtatatatactaaactactatgagctagttaatacagaatttcttgtctccattgttgatgggggtgactaaaatttgagttgagtttctgcctaatttcaacttttattcttgaatgggggatttccccatttttgaatactactatattcaagaagccaagcacaagaaatatttaaggataataatggctattttcttgcccaaagtggatattttgcatctctaggttttcaaactaatttatattgctcttaccaacttgttgcctgtaatcatattttccatattgatagtgagaatctttatctcattccctgcctttaaagataacttttattatagattttgttactgtttacaggatagaatgttactttaattcttagttttcaaagagtttttattaaaaccaagtattgaacttttgcttatctattacactagccatatatttttctactttagttaactactttggtgcattgaaaaaatacattttataatgcgtagtcaactttacagtcctgaaataaactgataattatgtcataattttattaatataccctgggtttgggctaaccactggttcatttaatggctttaacattttcatctgcctcactttgagtccaagataaaactggcctacggtattatatttctactttctttgttcaataatgttacaaatgttaccctaacctcataaaaacattaaaagaaattttagtatcatcaagtggtgagagaatttttgttttctatttcctcttactaattgtttccaagatacctggcttctctgtaaggctagtttaaaatgttacacttcttacagaattctagctctagataggccataattacataaataacagaggatgaaaatcccttcaaaggatgaaacatagaaattgatgtagtaaagctttaggctgtccaagataatgttttctatttaaaatattgcaaatctggccaattgaattaaattcactttgaacaggctataataagcacttacttttggtgtgagtaaataacaaataaatcacttaagaaaatacggcattattccccctcatggtgcatttaaactagaataaaaaattgttacgagaggaagatgaagtcaccaaaagagctgagaattgttaaagaatgtcaggcagaatactcataaggttgaactgataacataattaggtacttgctaaaaacttaccaagatacaacctgggcaataacaccctctagaatggcaaccagactatatagagtgttaaaaagaagaatcttggtaaaaatgaggctagcaattaaaaatgagaaaactaaggataaacagaaagggttctagaaacaattcaggaagagatatttgaaaggcatgtggtatgataaagttcaagtgacataaaattaatagtaatatcatgaagcaaaaagcagaaatggaaagatatagaacgaaaggggataatcacttgaatcacaagattatatatttgagttcagtacactgaaatatttcatttttcaatatgaaagacatatagtgacctctaggcactcattttaatatacaagagccattaaaaaggcacttcaaggtgttagcaggatctactccattataaccatggatgggaggtttgcattcactctgaaaagagtttcctttgcagttttatgtgagaaaaatacagtatcaaaatgattatattgtgatacagaatctccctattaaccaattgcaatgacccaaatatgaccccacaagaaatgaatctggtgcatataactaacgagatgggtgaaattgttcatcctgtaaaattgatggtcagtcactgaagagaagaatttgggactgcatttcaggaaaaagaaccaaaacagtaacagttctgcttctacataattatacggatcctcatgagtcacctgtgaagaaaacaaaacaaaacctcttctcaaaattctgtccactaatttctaaggaaaaaaatgtggtagataggaaacatgatactgctagagcacagagatgcagataatgaatgagaaatctttctctaaattaagatttttaaacattgattttgctatttgaatataggaagatgactcctgttttctcatttgatatatttaatggtgagttcacagatacaattgtttcctcggcttaaggtcaatgatcatggtggaataggaaaatagagaaaaatgctgaaagttttcagctttagtgtactatctgttaaaaagagtatttcaaagacactgtttttacactgttttaatgaattcagactatgtctcatgatcttttggaaaattgaaataatctcaaattattttcctgagtacaaaatgtcaatttaatgagagtttaaatgtgatgacccaattatttcaattaaattatacaatatttattagactataagttgcaaactgctatcatataactatgaattgcagaagatagaagaggatgaaataatacataagaccataaaattaattatatcattctctctttcatagaaacagacaatatatgctcattataatatttgatgacttagctatcataatcagttctatgttttcacaatactgtttatcctgttataaacctaaattccgtttgatcaattatcggtctcagagcaagggaatcagtcttgcatgtattaattgaagcttatggtatgaagtacagcccaaagattaattttgcaagaaatataactataaaccagattctgacacctctatacaacacattaacacatctttgtcataagcacgattcaagacaacaccactttagaactttagttctctgctgttgaaggttgggagattttgtaaaaattttttacaaagataatctagtcatttcaaaaatctgccataagagaaagattttaagtttgaaagaagtcagaactatagttaatgatactgtattgtttacttgaaatttgctaagagggtagccttaagtgtaacactatgttatacgcatgtacaagtgagtcttaaaacaaacactcatgattttacttgtagcaactttgatttgctctctttacaaccaaacttcttgaaagtgattttgactcccagttttcaattcctcatttaatattattttaagtcataacacattacttcatttaaagccctcctagtcatactcctaattgttcttgtctctaccaggcacttgacatttatccaaccattcagttattaaacaaatattttttcagtgcttgacctgctgcctattgctgggatatgtcctggaaatccaacagtggatgcttctattgttttgtctacctccgtaaatagctctgcttctgttggtctccagcaatgctgtccaatctcaaccagttagttatgcagaaaatgttgtaaaactcatgtgccagcattatctttatttttgcctcaaaaacagagcctattgacaataagagtaaaatgtttcagttcagaggcaagaattatacaagtgaacattttgaagtaatgacaatgagtgactataacaaaatttagagacttataaaggaaactacgtgatgcccaggtgctgaaacaccattcatagtggagaaatcaaagtcacgccatgtgtgttttacaaatcattaacacattcagaataaatgcttgaaaatatgaatagcttagagaggaaagagtttttctgtcctacttacttacctatctgataacttgtgaaaatggctgcttcaacctgtatgcacattcagtgtaacatttccaaaacctatactttctctaatatcaccgagccatgtcaggtgaaaatacacgtaatttctgtagctattgttttgtgctaactttacagaattttttcagtcaaccaacagtattacattacttagtagtgcccttgtctcagagccagttaatcataaacattccgacaggttgaaccatctaacaatggaatggattctcatgtgttttctgcacactcgctccccaattatgttctatgagaagatccagaagagactcccttcactaagggattaagaaacatatgggtaaggggagattttccatcagtgaaagttctctggttgctcacttctgtgggccagatatgactataaaagaggccacaattgagaaatgctcacagatttcaataagaatgatgtgattccagaaaatcacatgcaacattgtagcacttaaccaccaaacaaaatgtgggcatacctacaatcaaggctggcagagttgtacaggtcatcagagtgtcttggaccaagaaaacttgggcaggggctaaatgatattgacatccttagaacaaaatagagaccctttcagaatattgcttaattcatatgacaagaaattcttcaggtctggagccaaaaacttgactccagtcaccactgtggagatatagcctcccaccaagttttatgttaattttctgattcagagccctttgattaaatagggtgcctggagggctctgcactattgacgcaccactcacagtaaatctttccccatgccttccccaaagagacctgtggccttctttatagcatatctactctgtgaagcaattcactgtgaatagcttttcctggcacctgagaagtttacctagactactcttcttcatggatttcatagtctgggactactggtcacatctttctttccagaatactttcctattttttgttgttgttgctgtttgttgttttgagacagggcctcattctgtcccccaggctggagggcagtgacacaatctccactcactgcaacctccacctcccaggctcaaacgattctcccacctcagcctcctgagtagctgagaccacaggtgtgtgccaccgtgcccagctgatttttatatttttgtagagacaaggttttgccatgttgctcaggctggtcttaattagagggctcaagtgatctgcctgccttagcctcccaaagggatgggattacagatgtgagccaccatgcccgatctgcttttccatttggattcatggaatagcctctcctgattctacttctatatttttagctactttgtattattggagcataatatagacacagaaattgtcctaaattatgagagtgtaggtcaatgagtttctcaaatagaacaacctcatataatcactacattgatcaacaaatagggcagcccccacaccttagatatcatcattttgacctcttccagttagtaaccatctaggtttgtcattaccttgacttctaacactatgaattagtttcgtctgattttgagcttaatataaatgtatcatactgtatgcattcttttatgtatggcttcttttgctcagcatgataaatctaatgtttggaagattgcttcaatgttacatatcattatagtaacattcattttcttacctcttttgtatgagtaaacacaaattatccattctacttttgatgaacatttgagttgtttcccaaatattactgtattataatgaaaactgttatgaacattatgtacaagtctttggagaacatattatacacttctgttgtttgattcactcattaaatattatttttaccagtgttctgaaattggtcctctttggtgatcacgcatcacttttgttactacttatttctttaaaatttctacaaacacatctgtctgctgagaacttctgaacttttaacaggtacttccagtacttaatatttaattatttttcttctttaattttcctttctatattaccttcttagattaatgtgtgcaagacacacggtagagttacttaaagtattgcctttttcttatttggtaatgaaatgtgtcaattctacttaattaacaaccctatacttaatgatcttctgccacggtcttagtttctgccttcatcttatttgaaagtgtttgtaaaactaattttctgatagcaatgctgatgtctagtgatttagagtagttgggttgttaaaaattagttactgcattccaagataaaagttgttattatcacaaactctttgagcaatccttattgtagcagtgcacgagagaatgaagtgaatatcaactgagaaactggaaaataataagcaataaaatgcttgaaaagaaaaaaaaaaaagaaaacagtttttgtgaatgtttggcaggtgaatcccctgaggaatgaatgccttggtatttgtgactccacataaatcaaacggacataaaaagagatctcaattttggcacaaacaaattgatctgactggatggtggctgataaaatgcatctttaccccaagttcaaaaagatcttggctgatcaaggcagcaattcagaagataataaagtctggagagacttgaacaagttttgtggagtttatataaaaggaagactgagagggaaatgtcaaaatattgaggagtacaataccatgatcattataaacattacattactgaaggttgcatatatggatatatgcaaatgatatgaaagggatgaaaccttttcataaaaatataaaaaatcaacattcattttcactggtaatttattctaagccttatttctaatgatgctgtgtgtgtgtgtgtgtgtgtgtgtgtgtgtgtttctaggattaaataaatatgtgcctttcttctgggattaaatcttttcactcattttctcgttgctgctttgattgtgtccaaacatcttatgacagagatttggcttttgctttatttctaaatgcttctcattagcacctaggttcctgctgtatcaaactttaaatgtttgaaatactatatataattttagttttcttggccttggctcatatggtttaattttcctggaatagttttaccttacttgaccatttggaaaattcctattcttttctaagattccggtcctggatctcagtatttttgaaagcttctcttgaccttcataagcaaacctgtgttgttacttcttcttgtgtcatttttttcataatatacagccttggctcttcacctttagcatttacaaaaattgccattattttttaaatggactttctagccccaatgctaaatttgctcacaataatttttagaataaattcaaaaatatactaagaagattcttatacaaaaagtttgagtatcttactctgagaacactgttccatagctattatcacttttcacattaatattttctaacagtctttgttttccttaagggaaggaaaggataacatttattttcctagcacctgttatagggatagacaagtagtattaatttaataattgataatttttgtttattatacacttatgtggaacttaatgtaggtctgtacaattgtaagctttttataagtattaaactgattaagtctcattattaacctgtgaaggtgctactcttattccttgttttcaggtgagtaaactcaacagacaagttactaacttgcctaatttcaggcagttagaaaggcagctctaattaaaatataagaaatatgatttcaaattaaaggaatttatccacttcataacactctggaatgttgatttttaaaatatgtattgtagtataacactgacatatgtaccaacatcaaatgtacaggctgaaaaattatccaaaagtcagcacagcattataaagatgactcatgtgaagtaataaaatctgagctgaatcctaggaaattccttctttcccctacacagtagtaactctccctctcaccattatcctcacatctgttcatactttacagttatttatttcactcaacatgcagtttgtgtgtaaacaacacattgtacttatttattccatatttgatatctatttttccagtttggatctaatataaattatgtttctagaaagattattatacatatctttaggaggaagtatatgtacacatttatgtatttctatatacacactatatatacacacactgtatatatgaatacatacacacaaacatgcaaacacctgtatgcatatatagtcaggatggatttgggcaatgaggtcgaaaggatacgttcattacgttcattacaagattaagtcgaatgtttttcagagtcgtagtgatttacattcccttcatcagtgcgtgcaaatttcgtttgtgcagcttctatagaaaccctaaatacactttattttttaaagtttagctttttagtaattatagagtagaatttatttttatttttaatttgtatttaataaaagtagcttgatttccttttatttttttctttctttaattttttttttaattctgtgtggtaaagtgctttgaaaaggcctttcttgatgtttcatttggttgtacttttatttcttatttattaatttttttttttttggagatggttctaactctgtcacccaggctggagtgcagtggttgattagagctcactgcatccttgacctccccgactcaaaagagcctagctactcaggagtagctgggactacaggccagagccaccatgcctggctaattttttaaattttttgtataggcagagttctctcactatgttgcccagacaggtctcagatccctgggctcaagtagtcctcccactttgccctcccaaagtgctgggattaatgttgtgagccaccgtacctgaccatgttttttttttcaaaaaattcatttgtgaagtttaaaaagtatcttttaagagttcttactgtatttatattgcaaatttcattacccattctgttgctagccttttcactctcagtgagttattttatgattacaaatccttgtttatgttattttattactattaacttatttatcttatttattagccttcagtggttagttttttagtctttttttaaatcttaaggtcatagaagtgccctctatattactttttaaaaactgtactgttttatgttacacattggcttctatatgaaataatttttgtgtatgttgtgaagttggatgttaatattcatttttctctatggatttatgaaagacagcacaatttattgaaaatacatcttttccttgctgtactgaagcactatttttttcacaaatcagctaaatatattgttgtgtggttctctttatgagttctccattctgtttcattgaaatatctatacttgcaccttttccataatgtcataattaatatacatttataaaaactttaataaagtcttcacattatattttttcttcaaagttatttatgcactgcgtttttatttgcattttacagtcagtttttcagttgccgccaaatataatgcagacaaattacactattactaatcacagtattgtgattttcagtgtattacaaatatagatttatttaaaatactgactctttcttctaatactaggaataacaaagaaacatggtacatctttatttctgttgaatgtctttaatttctcttaatctttcacaattttcagtaaagggattgaatataatatgttatattttatattaggaattcaatgtttcttcctggaaacatttcagatttttaatattttacttgatttagactcactacatttggaaagcttcaattacaattttacttttaacagatatagagctactcagatttgctattcttgtgtcactatttacgattttttagaaatgtcttctatttcatcaaattatttcacaatttttgacttaaagttacttattacattctctttttctctctcgtgactatagaatctataatgatttcctcattattcatgatatttagaatttgtggatattcttttttaatttcatgcataatcatggtatatttttatcagtcttttcatagtaactttggcttttgctgatttcatttattttatgattgtttctttttctcctgcttcttatttatattctcttttttaattctttggatttaatttgacattacatttaaaatttttgagattgacgattacattattaattttcaaactttatttttttaacatatttatgtaaccatatatttatctccaagctgaggtttgcctaagtctcccaacttttaacaagcagtatttttactttcatttttattaaattcaaaatatattttaatgttcactgtaattacttttttgatccatgaataacttagaaatgtgatgcttaatttccaaacatttgttaactttcaaagtcttgctatagatttccagcttaataacattgttgtacaaaaaacactgtcaaagatttcaaatttttggtatttattgattcttgcttggggcctaacctcagcctctatctatctatctatctatctatctatctatctatctatctatctacctatctatcatctatcatctatctacctagacagagatatctatagatatctatggtaaattttgaaacatgttccaaatacactataataaattgtatgttttgctgtttttgagtgcagtttttatgtcaaagtatttaattctactgctttaaatgtttgtattattgatattttgtatcctttttgctatcatgtatcaaaaatgtgtattaaagtctttatgattgaagatgtgcctattgctccttttagttctataaattatgcatgcgcattaactgtgtgtgcgtgaatataaatacacaagttagacaacttcctcaataattgattcttttatgtgaatgatgtatacatcttcctctcaggtaataatttctgccttaaaatctctattgtctaatattaacatagctaaacaaattttcatttggcttgtgtttatcttttatatacatatatgaaatttttaaatttagatggttccatagatagaagatagaagatatatagatagaagatagtatatgtcttctacagatacagatatgtatatgtatatatacttatagatatattaatatttatatctatgtttataaatgtatatatgtagatagctatatatgtatatctacatatatatctacataccaatatatatctctaggtgtgtatatgatatctatatacatatagatatagatatgcaggtatatacatacatagataactatgtatatatatctatgcacatgtagaaatatagatgtagatataaatatatatctgtatagagttatgtgtagacatatatagatatatagataggtctatatagagaaccatctacctatatctagatagatatctatcaattgatatctctacctatctagctctagatagattatctaatctatctataaaactatcttgaaacgatcctaatttaaaaatcaagattcgttttaattcaaaaatcttaacttaaaagttaggaaccatctttattttgtggttcatatacaccatggaatactaggtggccataaaaaagagtgagatcaagtcatttgcaggaacatggagggagctggatggaggtcttcatccttagcaaactaatgcaagaacagaaaaccaaatactgcatgttctcatttacaagtgggagctaaattatgagaacacatgaacacatagagggaagcaacaggcactggggtctctgggagtgtggagggtgggaggaagttgaagatcaggaaaaacaactaatgggtactaggcttaatagctgggtggtgaaataatgtgcacaacaaacctctgtgacactagtttgccacataacaaacctacacaggtgccattgaactgaaaataaaagttaaaaatgatgaaaatacggaaacaaaaatcttcaaccaacacaaaacggttcatcccaagaatcatcttaatttaaaaatctttacatcttaagaagctacacgggaggctgaggcaggagaatcgcttgaacctgggaggcaacggttgcagtgaggcaagatcgcgccattgcactccagtccaagtgagagtgtgagactcagtctcaaaaaaataaaatgaaataaagagcaactttgatcttaaatagagtatatatccgtttacatttaatgtggtgaatgaaaaatttggttttcatttaccaccctacaatttgcctttctcaactaatactttatagataaaaggacttacggaaagcaaatatatgactcaatattccaataaaagtgcttgaaataatttatattgagcacgttatccttctttcttaaaaaccttaagctatacacattacatagataagcactgatgagaatctagtactaaataaccattatttcaaaggcatagatagaatgctttccaggtatggagtgtttccatacttcccttccatacattttcaagccattgcataacaaatacggaattttgtggagaggagtgaatttatatcctttaatattttctcactttagaaatgcagtcttggaatgatataaactctgtaaacagactatcatgttgtatttacgaagaattatattaaggtgtctatttttaagacaagaataaatatgtttttgttctaataatagaaatggataagcagaattctggcttataataatgagaacatactatcccctagtttgaaataagttaaataatttaactttctcatgttatcttgaagtttgtattgaatgtatcagtgcactacatgaaatgggacatttggtgctgtcaggcctctgagcccaagctaagccatcatatcccctgtgacctgtaggtacacatccaaatggcctgttcctgccttaactgatgacattccaccacaaaaggagtgaaaatggctggcccttgccttaagtgatgacattccaccacaaaataagtgaaaatggctggtccttgccttaactgatgacattaccttgtgaaatcccttttccgggctcatcctgactcaaaaagctcccccactgagcaccttgtgaccccccatgcctgcctgccagagaacaagccgcctttgactgtaattttcctttacctacccaaatcttataaaacagccccacccctatctcccttcgctgattctctttttggactcatcccgcctgcacccaggtgattaaaaagctttattgctcacacagagcctgttttgtggtctcttcacatggacgcgcgtgaaagttaccatcccttttatcctacacataaaatgattcagtggtttaaaacacttctttccatatcctgcagttttgcatagcaaaagaaacatgcactttgaggaaaatgtaccttttaattttttgtattttaaatattatgggtacaaaatatttgtatgtaattatggagtacatgtgatgtttcaatacctcctttttgatcccagatcttccctgaaatttttgtccaatttgtattgcattatttaagtttgagaaggagtaatgatgtttagtatatactgttataaaataactgattccaaagatgtaaagtatctgatacttactatgtccaaatataatttttaaggaaatgttcctaacgatgtgtaaataataacatggaataaaataaattcatataactttatgataataattttacttaaattaaaaagtgttatgtgcaaacagatggtatacgacgcgtggcatgcaataatgcaattgagtccaattaaatatattgtttgatttatttccacaatctgataaatgtattgtagaccaaaacatcaaaaaccataagtagggctgggcgcggtggctcaagcctgtaatcccaacactttggccaaggcaggcagatcatgaggtcaggagattgagaccatcgtggctaagatggtgaaaccccgtcgatacgaaaaatacaaaaaaattagccggacgtcgtggtgggcgcctgtagtcccagctaatcaagaggctgaggcagaagaatggcgtgaaccccggaggcggagcttgcagtgagcggagatggcgccactgcactccagcctgggcgacacagcgagactccgtctcaaaacaaacaaacaaacaaacaaacaaaccataagtagcctgtataatgtctttttattcgctgccatgtttttaatataaatatataagagcatcttaaattatttaaataagtcaattattttataagtgaatttagtattagaacatatatattcttttgcacaggaagcttttttaagtgtcagaaattatatacttatatagagacttttgttcacaaagtagttagttgtaggtacatacaacatacttgaaaaatatttttgtcgacattggatgcatttttctcttatagactcttaaaaatgttaacaagccaacatgtgaatatactgaagtattttttaatcttttctagtgtcgataacgagttggttgatataaagtcattagagtggcaattcaacaaatattttctatcgcataacaaatgtcattaacttgctagtctgtcatgctgttgcaaagataaagccacattcattagtgttttttgttgttgtttcttattggtgctttgtttgttttgtaacatgaagtggcccacttcttgtattaaattatttattctttctgaaaatgttcaatcagaatgtaataaaacctttgaaaaatgatttaaaaatttattcctgtaggtgggaaattgaacaggtgagaacacttagacacagggcagggaacatcacacccctgggcctgtcgtggggtgggggcagagaggcagggatagcattaggagaaatacctaatgtaaatgaggagttagcgggtgcagcaaaccaacatggcacatttatacctatgtaacaaacctgcacgttgtgcacgtgtgccctagaacttaaagtacaataaaaaatatatatttatttctactgaacaaaatgtccatatattagatggcctaggactggtaggggtctctaatccaggggattgttgataaactgagacaacttctataatttttacattgttactcttaaagtcttgtcattgtctgactgtctcaatattggaaaataacgtcaatattcagtgtaataaaccagaagaaaaatgggccgatatcccattcaattaaagacattgaaaagaatgtgtatgtattacttttactcacatcttaatgctcatcgtgttgtcaccaagccagatagaaccatatactggggaatgtaatgtttatctgagaaaccaaatgcctaaatacaaattttaatagtatgaagtaagaggaaataaatatgggggattttctagtcttctccattagatataaattgcaagatttggccactttaaaaaatattaatatttactaatttttcatcaattcaaatatcatatcatagagagcaatttaatcaaattagataacagttctaaatataaaatttaactgtatatctcccagaaaccaaaaaatgagaaattatctgtggcttttggctagacaaaggtttcttagatgtggcccaaagaacaacctagagaacaagcaaaaaaaccaattacaacaacagtaaatatgacttcataaaaacaaaaaattctatatttctagcctaaatgactcaaacttgtaatagacatttccaaattatgtctgataaaggatgtgtatccaaaatatgtaaactcaattttaaggcaaattacagtccaataataaacaataaggaaaagaatatatttgaacacatactttgccagaggaaattcagagacagcaaataatcacatcgaaagatgttcaatatctttagccattggagaaatacaaattaaatgagatgccattccacacctactagaataaatataattaaaaatactcatcatcttgtgtgttggtgatgatttaaaaaatctgtagctctcaaatactgatggtaggaaagtaaatgatacagccactctggagaaaaaaatggattgtttcttacaaagttaaatagacacccactattttacctacttactctactgttgttctttaagcagaaaacagtagagcatattatacatataagaatgtgtttacaagtgtccatggcaaacttatttataataagactaaactgtcaacaacccaaagtttatcaatgggtgaataaataaatccaacacggtatactcataacatgagatataacttcacacacacataaaaccatattttcagcaaatggtgctggaacaattggacatccacatccaaaaaaagaatctagacactgtgtttacacaatatacaagaatggataatagatttaaatataaaaatgcgagactatagaagaatattataaattgaattttatataagttagtacttctgctctaggaaagacatagtttatatttaaaaaacaagccaagactgggagacaatatttacaaaacatgtatccaatgaagaactggtatgagcaccccacagaactcttaaaactcaaaaagaaaaaaagttaaataatccagttaaaaagtgggcaggagatctgaacagacatttcaccaagggaaacatattaatggcaaataagtaaatgaaatatgctcaacatcatatattgttagagaactgctcattagaacaagataccaccacatgcctactaaaatggctaaaatccaaatcactgacaacactaaattgtgttgaggataaagagcaagggaaacttattgattgcttgtgggaatgcaaaatggcacaaccacgttagaagatagttttgcatttcttacaaagttaaatgtagtcttaccacatggaccagtaacttcacccctatccaaatgagtcaaaaatctttctacacaaaaatgtcacatgactccttaaaacagcttttctcgtaacaaaacttggtagctactaagatgcccccaacaggtgagtgatggctcaataaactggcatatctataaaatgggatattcagtgttaaaagaataagctatcaagccatacaaaatatgcaagaacctagagtacatataactaagtgaaagaagctaatctgaagaggctgtacactgtatcattccaatgatgtaacattcttaaaaaggggaaaatctataaaaagatcagaatttccagtagtctccaagggaaaggatgaataaatcaagcacagaaatttttaagaaagtaaaactattcttataataccatagtagtgggtacatgacatatgcacttgtcccagcccatgaaatgtataatgccaagagtgaaccctaatataaaactaatatatggactttcatttataataatatgtcaatacggatgcatcagttataacaaaggcaccacactaatgcaagatactaatcataaagaatatggagggtagaagaaagtgtttggaaattctctgtgctttgttagttttttctataaacctaaaattgttctcaaaataaaatctattaatttaaaaaagaatgaactattgttaccagtatcaacataggtgaaagtcagagtagttatgttgagtgcaaaagacagacaaaaaagaatagattttgtgtgattacatttacataaaattctaccaagtgtaaaccattctgtagtatcagaaatagattagtagttgcatggagattaagtagggaagaggggaagaagccattactaaagacacaaagcaactttggggaaatgaatatgttcattatcttgatcgccatggtgttttcttatgtaccaatatgccaaaactttaaaaataatatacactggattatgttcagtttatgtcaattacacttcaatgaaaaacatttaaaaatattatgtatcttgattttatatttattcagagatattattattctctacctgccatatatgccttttggcagtgtaaagatatataaacatagtatgtaaatatggtatttgtaatattcttattcatatgcaaagatagtttacatttaatttttttaacttttcttctatttttattctgtatcctccagacattaacattgagaacttcatatactattacatatttaaaaatgagtcatgtccagtataatacaaaatttcagcaatgtgacatgacaggaacaaaatataaatgaagttgctttatatagattcattttgctcattaaaacatttcatagaataaatcacttattcaaaagtattaacatatatatttaagagtgcactatgaaaaaacagaatcaagaaatggataccagattgatactcactaaatcgtatgttaaagcattttgaataattttgtagtttttcaaaagtaactcacacatgtcacatattaataatgtatatatttatttttaggaactccttttagataactattaggtatatagttttatgctgagttttatgagaactagaaaaagcatatcattttatgtcagaaatagtatattggttcctaggtcattttctatagctgtcaaaatgtttcaatgtcttttaaaactcaagaaaatgaggaagaaatacagaaatattcctaggttaattgtttttatatccttatctagttctttctattcttaattatattaattcttcccaatggcttatttaaaaatgggtcttcaattgtctttcattaaaattctatggggtctcattacctgtaaaaaggttttatttcacacgaagtattttttggttatgtaaaaggaaactaaagctctgggctaaataaataacttttttaaattttccctattgggaagtagttgaatatatacattgctgtattcagctaaaacatattagaatgtgcttttatttacaataaaaatgaaataaggctgcgttacattggcaagctgtaatgggaaatgtatttgtcaccctaggcaaactgaaaaggcaggtatattgaattcagtaatgctgagtaattaagccttcacttacaacccttatattagataattcaacttaataagttaagtcattttccaagtgtttgttaatgtatcaaaaggatttatacatttcacaaacggggactcaagctaaggtaaagatttataaacacaaccaattcactagagaaagaattttaagcttgtttttcttgtttttccaaacctaactctttcatggaaaaaaataaaggcaatattataaaacagatgaaagtgcaggtaattaccttaagtgacattgagaagcctagagctcacctggtccacactatttgataagccatgtcacccctcatttacttccacggttcccttcaagattgaagagctgtctgaataccacagtcttagtatattatatttttgtaaggaaacctgctcactcaagaacatcttctgtgagagccaatccattcagcatgttaggaagtttccttccatgtatgattcaggcccacctgatccagtggattggacaatgaatgaacacttgatttaggtggaagttatccatttattgattagaaatcagtaagcctctttcacttgagaattccaattgagatgaagaatataataggtatgcatactggatgagcaaagccaaatagcctccgtaatgttataaagaataatattgagccacaggcaagcagtggagatacaaagagtacaagagtaagggaacaaatgttgccctggagtgagagaaattgataaaaagccactgccttgatgttggacaggttcttagttctatgttcagcctttattttctgctcttggattctacactgtacatttcaagtttatttacaaatggttttgactacagaaaaagcaagtgtgccattatgtaatttttgacgtattttgggagaaataaagtaaaaagtattttttccttttcttttatttatttttatatttatttatttatttattttttgagattgagtttctctcttgctgcccaggctggagtgcagtggcgtgatcttggctcactgcaacctccgtcccccaggttcaggtgattctcctgcctcagcctcctgagtagctgggaatacaggcgtgtgccaccatgcccagctagtttttgtatttttaatagagttggggtttcaccttgttggccaggctggtctcgaactccagatctcaggtgatccacccaccttggtctcccaaagtgtttggattacaggcgtgagttactgcacccagccacaaaaagtattgagagtttttcaaagtagtttctgagttacatgtaaaaacaagataaaaaaatttactaacagctctgcagctttcaaaattaagcagtcagatttctatgtggctgagaatttctagcagtctcctccattagaatttgccatgcccaaaatgtcctatgctgtacagttaaatgattgatgtttaagtaatattcagtttgaaagctgactttaaatgtttccttgaggggaaaacatgcttagcatttcattataaaattatccaagctttgctctcatttctatgttcaaattcaatgcatgagttaaagcatcttaagacttccttttaagcaatttatatatttgccctaagatttcaactagtcctaatatcagaggatcacttcattggaaaagttgtgcaaaagtaaaatgaaatggagattaactactaaattgtcatgttgagattcgtgataaatttagttacaatgatattattcaaattggaattaactgcaactttcctaggtatgtaaatgaaagtggagtgaaattgctatataaacctagggttatgaccatcaaaatacatgatatagcaatacaataatttaatgttgactcagggagtaataaatcagatatttcattcaacaagctgtgattttttaattataacttaagaattataagttaacatttataagtattgtttcttaataatgagttgacaaaaataatagttgaaaaatacaattatatagcatgattatattgtgaaaatttacattaaaaattaaaataatgaataaatcacctttggaaactactgttatttaaaatatcaggagtccagaaaattgcaacttattttgatctacataatcatttttacatgaaaatttaattccaaaaccattgcaaagattattttcttaataaccatagtattaagaatcagtttctgtgaaagtacaatagaatacaaacatatcctagatgtattgttttctgcatttatgcaagaacaataagattttttaaatgtttgacttatctgtggaaatatgatagagacaattgtatgatttggtttaaggattactcatttctgtacttagatgaggtaattttttcttttctagataaactctaattccacttttttcatacagtacacacctatacatgcatatataagtttccgttaaacaacagtagtaagatttgaacagattatttacctacctttctgaaaagtgtctgttaacattgttataagcctataagggaagaaagggactatattacaaaagaacagaaatgatccaggagagtatgaacacaactggattctaagaatactgggctattgggtatcgggatgtagattgggataaaagattatacccctatcagaacactgtcagtttcactattgatgtggtacaaacacatgataggatggtttgcagcatcaaggaaaaagtgatggcctcaggtgaggttgcaatgtcaaatttcccatggaagctgacagaagatgcacacgtcacaaagaaaataacatgtagaatacttaaaatctactctcaataatttttaagttattttaaattatatactattgttattaactatagtcactattgccatagtcgctataactacagtcactatagatctattacataatgtacaatagatctctgaaatttacttctcctgtcaatttaaattttgtttcctttgactaacattgagatagcaatttttatcacaatttaaaaattataataacataaaacaatataattttacagcaaggaaaaggcatttcttgaaagttaattcacaacattgaatgaattgctaaacaaaacattgtcaagaaccaaaacaactctagatatctcaggcagaatgaattcaaagaaaatgactgtgcatattatttctcaacattagattcacaatggaatcacctggggcaattttttaaagaaacaaatgcctaaatatcatatccagattctaatttatttgttattagatatggtctggaatcactctactcctgacgtccctgctcaagaatcaacttccaggaagagagactgggactcactgattttggtgctattcagttgaactatgcccctactgattttccacctgctggttctattcattatagatagggagatgttaacatctccaattataatagtagatttatctgtctgttcttgcagttctatctgttttcacctcatgtgttattgacagcccgttacatgcaaacacattaaggattgttatgttttcttggaaaattaaaccctttgtgactatgtaatatcgcttttgtatccccctataattattcttgctctgaagtctttttgttggaaattaatatattaatccagctttcttttaattagtattatcatgttatatatttttcaaagttaactctcaagcttgtccacaatgcgcttccagaaattaatcaactacatgttaaagttttctgctccattactaacatctatgggggctcctgggcttttgctccactatgctacaattctttgcatttccccatctctctaattaagtggagatttagggtgggggcagcagtttgttctgtggcctcagtcccctaacggatttaaaatgagttgttgatactctgtttatacagcatttttcttgtaaggatgggagtgatgacttccaagtttcttacatgcttgaataactgacattttttactatattctcacccctatggtggtagaaaaatgctataatttttggatccacagaactaaagtactaggagaggggttttttcacaggaaagatggttgctactgaaaaaaaaaagaaaaaaaaaagataaagtcttctctgctatctctgctagattctctaaactctcttcctgtctctggagtccagacacacaagcctccttttagttttgagctttcactatgcttttatcttaaaaactttgcctactatgtcctttctgctgagaaagcaccttatcccctcaattacctagttaacatcaaatatcaaatcatacttcttactgaaggccaagtaccacctctagaagttttccctaagaacagcctacatacacttaattctgtgagcccttttcttatatcctttgaatgctcttccttcacattactcttccttcacagcctttagccaggcaatatattacaggaaaacagggagaacataatttttgccatttactcttacctttgcctagcccagtgcctggcaaacaatagattctcattatgtattttttttgaatgaattaataaatccaagtaaaataattgatgttttggaattatctaagactgttaaaatcagttaaatatagttaatgtgaagcaaaaaacagtaaacaaaattaatgtaatatacatgctgatgttattttagaaaaaacacaataatttacaaattcctttcaataattcaattaacttttatgagatttgattgaagacaaatctatgaatgctttgttgtaaataaaaggtaatccttgtaataagcaaaaataaattaacataacaaatatcaatttacagatagatgaaaagtgattgttttctagatgaaaggaagattattaatagttggcataagaaatcaaaaattagttcaacaattagtcatacggaaatgttgaatattgacattaatgtgataaagaaaacgagagtttctgcaaataacctcccatatctgatgtgaatctttcacgtcattctatagttcaactagttcttaataactcaaaaacaagaaggataaaatccatcattttgtttggctacccagatccctcctgtagctgtcatacagagtgtgatttatgagttgtaagttgtgctgtggagcttgacaagtaagtttgatttcatttagtatcttctttaaaccatcttagatcttctctttgacaagaatttatgttagtgttctcaaaatgtaaaatgggtaacttaatgagaacaaaagttgtaccctaagatatatttgcattatctacatactcacaattaaatcttaacagttcaaatatacccatttgtaatagaatctaacagttttcctcttgaattttttgacaccagaaatttttggtcccaataatgtttagcttcctagtcacaaaccaaacagaaagcaaatttcatcagcttagaatggttaaaaccaacacagctgcaatatttttatttttgttttaaaattttgtttagtcaaatatagttttaagatgagtagaaattctcctgaagataataaagaaaaagtatgtcatataatatcttaaataaaaataataatagttattaattttttctgctcattatgttccagaatctgtactaagcattttagaggattattttatttaattcacacaataatcccttgagaaatatataattattatctttaattcacagttattgaaaatgagacacaaagaggttaagaattttgtccaaggtcaggcagctaatgtgacttagcaagggtgtaattaagaaaaaataagtctttcttatcttatgggaaatttggaaaagcaaatatctaggttctctttttaattaaaaaatataaaatgtaaaatgtgagtctctcttaaagcagggaatcaactttaattaaattgaaacaatacagaatcttttgttattcaggctctatattattattatctctgctgatagcaaaagctaagaatagaaaatatttctgacccaagttggtaaattatgaatcaacctgctagataatcagaataggctaacaagtggaattaaatgtaattattctatattaaatataatataaacaatttcttattataattttactaagattctaccagttgcaactgaaatataacattttaaatccaagcttaataaaagaacttggcatgagatgttttcataggaaatagtgacaattcatattatttttaagtgtaaatgagatgtattatttctgtatttcattttccttctaaaagttatttttaaagttttagtttttctgaagttgatagctattactaactcttttgggcaaagttttttgagatagattaatttatataattaggaagaaactaaagtagttgtgaaagtttctaaaaagataataaagtagttgtctttatgttataatagaaaatgagaatgtgaacgcagatcattttgactctcagagtttgtgttttcagcaaatattacctgaatattgatatataaattagaattccccaaaggaaaacatttaaaaatgttaaaattaataaaatcattagcttatatacttgtccttagtatcaggacattctccagtggattcaatagagcatctgcagttttattttttgaacaaaggtttctgcaatatagactcatggtgtgagcttactgggtcatgttctttgttccttcttggagctttgggaggcatttataaaagagctgctgtagtagaaggactgagttgtatcaccctgaggatttaagtttctgcgggagaatcaaattcactttagtatagggatttagtaggtttccctagccttattaacaaaatatcatggactggattattaacaaaatactaatacgacatgaaaagtgcatactttgtcttacaataatccagttaagacactatttttgtatagcaaaattctttactacacactagttacaaatcaagtgagcaagaggtggtcatactgctctgcttcctattcctgccctttcctcctaccccagctgaaaatacttgctgcaaatgtccttttataggagactttgaccccagggtgtagaaagggaaaggaaaaggtcagaaatatatgtcttgtctataacttaaatctaataccagcacaaaagcctgaaaggactgatttttagagagcgttggcaggaaactgctctgctatcatctgttttaagctacttttatacattatttttttcggcttctactctgctactattcaactgcaatttgttttattgtacacttcaacaccatgaacagtatcttagttattattgaaatgtattacaagttcataaagaaaacagcattttgtttcttcagtcatctactttggatgaaagtgttatttagaaaagactaaatgggaaaaataatacattaaaaataaaaattgcatattaattttttagatcaaataaaccaattttcagcattttcatggacctttataaccaaaataaataaacatttaaagacagatgatttaattcagtattttgtttcttgaaaatactggaatatgtgttttagataatgtatatatttctgttattgaaaagttttcaatagtcagctgacttcatatgcaactttttgcaaataataataccattttaaacttattcaaggattttaggtgttcttaaatattattttataacttattttactcccctaaagtaaatatttatggcatctgtaagccattgtacaattggtatagcatagtattaggattgtcctttgtaatattttatagtattcacatttgtatttaatcgcaaatttgatataatttagccaagccttcaatacatttataaagagagcactactgagactttatacaatggaataaaataacaaaatgtgatggcagcattcttccactcaaagagatatatatattttttattctatccaatttttaactaattttattttttgcacccaatggaggggaaaattactaaaagtgtgattaaggctattataagatacataaactgtatgacacaagcattctcaactcaactttacacttcacattgtttatgaacttagtatgccagctttttaagtgtggtggggtctggtattccacacttatatgtctctgaatcccacccttgtgctgatgctaagatgaactgaagcagggatgaatttttctcttacatggaaacatgaatatattccaaactggagggagctctcacaagcagttcgcctacggtaattactttgtgccttgtaatgggtcacacagtatcctcaaaaaggtgtgtctgagtcctagaccctctcccctcccagtacctgtaaatgtcaccttattttgaaataggagctttacagataaaataaagttaaagatctcagggtgagatcatccggaatttagagtgagtcatggatatttgggacacagaaacacaagcaaggtcatgtgaagatagagacaaaggttacagttatgctgtcacaagccaaggagtaccaggaaccacccggaactagaagaggcagggaaggattcttccctagagccatcagaagaagtacggtcctgagtacgcctggattttggtctttttgcctctataagtgagagatattattattattactattattattattattgtaacaattttaagccacaagttttgtagcaatttcttttggcagcactaggaaactagttaatgcctctattatttggttaaacaaagaacactattaagtatttttaaaacaatgtatatgaatgttgattatggtaagcaaacagtttataatcagatcagtttctatgtaaaatttcatgttattatattgattttgttttgttttaaccatacaagacttgcttggatgtggtaccattgaataccatccccattccctcctgtcccacaactttttgaaatttatggggctttgttctagactgaatatttcttttccctcaaatttcatatgttaaagccctaccccacaatgtgacagtattgggaagtgaggtctttgagaattaattaggtttagacaaagtcatgagcttaggaccctcatcaatggaattagtgtccttataagaacaggaagtctatagagtgctctctctctctctctctctctctctgtgtctctctctctctctgtccatctgctacgtgaggaaaaagcaagctgggaagaagacctcacgaggaaacaaatttgccagcaccttaatcttgcactttccagcttctaaaattctgagaaataaatgtctgttgtgtaagccatccagtccatgacattctgttatagaatcctggactgactgatatgggctggaacatgctggagagatggtacaaaatctaattttagaaaaatattttaagttgtaagatctgaggcaaaaatcagttaaatattaccatttacattaaccaaattactccatttgcagtatcaaattaaggaaatttatgttttattcaagcttttaaaatcagcacacccactttgcagaagtaattaataacccatgattattaattatgtttgccaatttaattttcatccagtattacttgcagggaaagtttgaaatagataaatcatcttccttttgagatgtcacttgtatcactaaaggctacctataatttctgtaattgttactctttaatgcaactttaaacttcgaagaaagatgtttcaatatttttttttggtttttgttttttcttttcttttttgttcattttgtttgataatgtatctttttatattattattatactttaagttttagggtacatgtgcacaatgtgaaggttagttacatatgtatacatgtgccatgctggtgtgctgcacccattaactcgtcatttagcattaggtgtatctcctaatgctatccctctcccctccccccaccccacaacagtccccagagtgtgatgttctccttcctgtgtccatgtgttctcattgttcaattcccacctatgagtgagaacatgcggtgtttggttttttgtccttgcgatagtttactggcaatgatgatttccaatttcatccatgtccctacaaaggacatgaactcatcattttttatggctgcatagtattccatggtgtatatgtgacacattttcttaatccagtctatcattgttggacatttgggttggttccaagtatttgctattgtgaatagtgccacaataaacatacgtgtgcatgtgtctttatagcagcatgatttatagtcctttgggtatatacccagtaatgggatggctgggtcaaatggtatttctagttctatatccctgaggaatcgccacactgacttccacaatggtcgaactagtttacagtcccactaatagtgtaaaagtgttcctatttctccacatcctctccagcacctgttgtttcctgactttttaatgatcgccattgtaactggtgtgagatggtatctcattgtggttttgatttgcatttctctgatgcccagtgatggtgagcattttttcatgtgttttttggctgcataaatatcttcctttgagaagtgtctgttcatgtcctttgcccactttttgatggggttgtttgtttttttcttgtaaatttgtttgagttaattgtagattctggatattagccctttgtcagatgagtaggttgggaaatttttctcccattttgtaggttgcctgttcactctgatgggttgctgtgcagaagctctttagtttaattagatcccatttgtcaattttggcttattgttaaattgacttaaatgactaagactgtagcttaaatgaatgagattgtggtggagaggatattccccaaactaactctgtctctgacatttaggggtttgttgtaatagtaacaccttgctagcaatcatctactagtgatttgctcatggaacatgctggagagaaggagtgtctgagtcctagaccctctcccatcccagtacttgtaaatgtcaccttattttgaaataggagctttacagatataataaagttaaagatctcagggtgagatcatcctgaattaagattgagtcatggatatgaatatatgcatatatatatatatattgcatgcatgtggaggcaggttgtatataatataatatgtatatatattacatatgtatagtgtgtgtgtgtgtatatatatatatatgtgtgtgtgtgtgtgtgtgtgtgtgtgtattatatacaccctgcctccacatgcatggcctccctcattatcagtatcctcccctagagtggtacaactgtcaaaattgacttgcctacattaacacaatgttgtcacccagtggtaaatatacataacataaaagatataatttaatcattttaaattctaaaactcagtgatattgaatacattcacaatgttgtgtaattaacactgttttcataacttttatatcacatcaaacagaaattctgtaccattaagcaataattctccattccccttgccccagcctccatgccctagaaacaagcaatctgcattccccctgcatgaatttgactattcgtgatctttcatataagtagaatcatgtactatttgtccttttgtatctggcttattttatttagcataatgttttcaagatttatccatgttgtaaacatgtatcagaacgtcattccctttttatggctaaataatattcccttgtgtgtacatgccacattttgtttatccacacatacaggtttgttttcactttttgactcttgtgaataagaatgagtgatggtatctggcatgtgcaggcagccactttcttgctaaagaccaatagcatcaagcactctactaatggttgtaatttatctgattaggatccagatttccaaaaatgttaattcttattttttccagttcaatggcagttttcatggaggtattgacttctaaaacttcctattccaatcttctgaaatccactttaaaagagtggtttaaattctgtgtttgtaggatgaaattgataaaaaaatattttaacaactttcaaaattgcattacagagataatgtctttggctattgggtgttcacatatttggtatgttataaacaactttctggaaggtaaaggccttttatctcacacttaatattaagacaggaaccattgtcctagcaatagcttttggatttgatgtgatatatttgtatgtaatgagtttttaaaagttagagtgaaaagtcacctcatacaaaacaaaataatttttactgttataagaaagtagttattaattacttataaaacatgcaagtatctttgtgatatttggtgatttatttttctccagtcatcttgtgttgttcttagtggagaaaaaaatatgggtgctctttgtctatgacaatgtgaaaagtaagtatatggtttccctaaaaattcttctaagtttttaatcctctaaaatgatcattgatatgtaaaaataaatattaataatagcaacttaaggatcatttttgctgttatcagaaattgaaaatactgtaacagtccatcaataaatggttatgtatattatgatatatagcatacatagcgtatgtccatatatagaatatgtaagaaatgtatacaacaaagcacaatgaatacacgattatactaagatggatgggcatggatccacgtattattctgtttgtacatggtcttttccaaaaagaaataaaatgtaagaaagaagaaaaaaataaagagaaagagaataaaggcaactaaataaaatataaaccaggatgtgtaagtggtctcatcttaggactggaacaccagtaaagcctctcttctctggaaaaagtttatgtctctgaagttttctcagtgcatcacaactgacagcagcaggaatgtgtttttgctaacagcaatagaaaagcaaaactgtctcaagattgtaatattaatccaaaggttaaaacttcttaccttagtgttgctgctttctctatgcacatcccaaaggacctaggaaggtggaaaggacataggagatggaaaatgtagaaaataaaaaaataaggtaaatttaaaaggtaataagactaacatccattcattcacattaagctcctaattgtaacacattctctggtagacactgcggatatagcagtgaaaaaaaaaagaaaaaaaaatatgcctttttggagcttatattctcttggaaggagatattatatagcttaattacttttgttattatatatgttaagtgttgataagtgctatggaggaaagcaaggcagacaaagcaatcaggcaggagaaagaaagaaagggtattcaattaggaaaagaggaagtcaaattggccctgtttgcagatgacatgattgtatatctagaaaaccccattgtctcagcccaaaatctccttaagctgataagcaacttcagcaaagtctcaggataaaaaatcaatgtgcaaaaatcacaaacattcttatacaccaacaacagacaaacagagagccaaatcatgagtgaactcccattcacaattgcctcaaagagaataaaatacctaggaatccaacttacaagggatgtgaaggacctcttcaaggagaactacaaaccactgctcaacaaaataaaagaggacacaaacaaatggaagaacattccatgttcatggataggaagaatcaatatcgtgaaaatggctatactgtccaaggtaatttatagatttaatgctatccccatcaagctaccaatgcctttcttcacagaattggaaaaaactactttaaagttcatatggaaccaaaaaagagcccgcattgcctagtcaatcctaagccagaagaacaaaactggaggcatcatgctacctgacttcaaactatactacaaggctacagtaaccaaaacagcatggtactggtaccaaaacagagatatagaatactggaacagaacagagccctcagaagtaataccacacatctacaaccatctgatctttgacatacctgacaaaaacaggaaatggggaaaggagtccctatttaataaatggtgctgggaaaactggctagccttatgtagaaagctgaaactggatcccttccttacactttatacaaaaattaattcaagatggattaaaggcttaaatgttagacctaaaactataaaaaccctagaagaaaacctaggcaataccattcaggacataggcatgggcaaagacttcacatctaaaacaccaaaagcaatggcaacaaaagccaaaattgacaaatgggatctaattaaactgaagaacttctgcacagcaaaagaaactaccatcagagtgaacgggcaacctacagaatgctagcaaatttttgcaatctactcatctgacaaagggctaatatccagaatctacaaagaactcaaacaaatttacaagaaaaaaacaaccccataaaaaagtgggcaaaagttatgaacagatgcttcacaaaagaagacatttatacagccaacagacacttgaaaaaatgctcatcatcactggccatcagagaaatgcaaatcaaaaccacagttagataccatctcacaccagttagaatggcgatcattaaaaagtcaggaaacaacatgtgctggggaggatgtggagaaataggaacacttttacactgttggtgggactggaaactagttcaaccattgtggaagacagtgtgatgattcttcaaggatatagaactagaaatatcatttgacccagccatcccattactgggcatatacccaaaggattataaatcatgctgccataaagacacatgcacacgtatgtttattgcagcactattcacaatagcaaagacttggaaccaagccaaatgtccaacaatgatagactggattaagaaaatgtgtcacatatacaccatggaatactatgcagccataaaaaaggatgagttcatgtcctttgtagggacatggatgaagctggaaaccatcattctcagcaaactatcgcaaggacaagaaaaccaaacactgcatgttctcactcataggtgagaattgaacaatgagaacacttggacacaggaaggggaacatcacacctggggcatgttgtagggtgaagggagaggggagggatagcattacgagatacacctaatgtaaatgacgagttaatgggtgcagcacaccaacatgacacatgtatacataggtacgaaacctgcacattgtgcacatgtaccctagaacttaaagtataattaaaaaataaataaataataaataatttaaaaaaattaaaagaaacaaaacaacaacaaaaaacaaagcaaataacatgaggaggagatacaattttaagtagggaataaaggatggcatgacagagacagtagcatatgagtgaaaagcttgaaagaggtgatatggtttgactgggtcccccactaaatctaaagcttgaattgtagttcctgtaatccccatgtgtcatgggagggacctggtgggggttaatttaatcacggggtcagttacccccatgctgctgttcttgtggtatgagtgagttcttatgctctctggtggttttatcagggtctttttccccattttgcttggcacttctccttgctgccaccacgtgaagaaggatgtgttgcttccccttatcatggttataactttcctgaggtctcaccagctgtgcagaactgtgactcaattaaacctctttcctttataaattacccagtctaggatatgtttttattaacagcatgagaaggaactaatacagaaggtaagaaagcaatccaggggggatttgaagacaggtgttttcagtcacagaaaccatgtaaaaagcatctaatgtgagagtgctataatctgaatgttgacagccccccaaattcatacattgaaatctaattcacagtatgatactattaaaagctaaggtctttggaaggtgattatgtcatgaatacagagccttcatgaaggagattggtgcctttataaaagatgcctgaggggttggtttgtcccttccaccatatgatgactccaccatatgaagaagatgggtctatgaactaggaaatagggcctcatcatatatggaatatgtgagcacattgatctgggacttagcttccagaactgtgaagaataaatttatgtcctttataagctacttactatatgatattttgttatagctgctcaaatggactaacacagagacaattcccagcctgcccaaagagcatcaggaagtgttgggtacagtaaagctggaacagagccacgaggggaagagcaacagggctgtgatcaaagaggtgtgcctggtggggagcatgagtagagctgtataatctgtacaataatgacccagagtggaattagaagtccttaaaagtgggtgagcagagtggcatgatctctattatattatgttatattcttgcttggatattgagaatagactgaaggtgagggctaatgcagaagcaggaagggagataaaaattcagaggagacatgatgttggcttagcctgggtggataacagcagtagtaaaaattatttaaatgttttgaaggtaggtttgctgagaagtaattttggaggtacattaccaagactaaatttatattttataaaatgaacaaatttaaggtgtataccttaactttatatatttatgcactcatattcacaccacccatattaagataaagaacagaaactcttctggtgctttattccgcagaaaaccttctggtgctttattccagtcaataacaaacactggtcaaaggatattctactatgaccatagttttcttttgcctctcgctaaacttagtttgtctggagtcatacagattttaagcttttgtgtctgacctattttactcaacatgatgttttggagatacatccatgctgatttatgtgtctattttattttttattgctatgtattattactctgtaagtcaatatcataatttgtttatctcttctcctctttatagatgttacatccagtttttgcctacaaagaaaaacaaactgctatgaataaatttatatctgtctctatcgtgtgaatacacaccctcatttatttttggaatatacctattaattgaattatgatgtcattgggtatgtgcgcagtttaactttataagaaatagccaaacttatttaaaatgtagctatacaatttactttcccaccacaaatgtatgagattttctttgtttcataacctcttcagaattgctatattcagttcccaattttttttcttaagagatggggtctcgctctgtcacacaggctggagtggagtggcataatcatagctcactgcagccttgaactcctgggctcaagctatcctcccatattggtctccaggtatttagccattttaattttaccagttctcttggacatgtaatcacatctcattcaggcttttattttaatttttctgatgaccaactgtgttcaacacatttttttatcctgatcacccacttggctgtcttcttttataaactgactgttcaagtcttttgcccacttttaattgagtgatttatcttttgcataacaatttataggatttgtttactctccaaagaaatcttttgtcaggtctatgtatttcaaatatgttatctcactgtgacatttctattcatttttaattgggataaaaacataacttgtgatctatccttttaataaggttttaaatgtaaaatatagtactgttaagtataggcatgatgttgtacagaaaatctctggaacttatgcaacttacacaactgaaattttatacccattgaacagcaacccttcttcctccttcccctaaccattctactctctatttctatgagtttgacttttttatttttattttttttgagacggagtctcgctttgttgcccaggctggagtgcaatggcgcaatttcggctcactccaagttccacctcccaggttcacgccattctcccctcagcctcccgagtagctgggactacaggcacccgccaccacgcctggctaattttgtgtatttttagtagagacgggggtttcaccatgtttgccaggatggtctcgatctcctgaccttgtgatccgcccgcctcggcctcccaaagtgctgggattacaggcttgagccaccgctcccggctgagtttgactattttagaaagctcatagaagtgaaatcatgcagaatttgtccttctgtgactgacttaccatgctgacatgatatcctccaggtttatccatgttgttgcaaatggcaaaatgtacttcttaaaattgaaaatattccattgtatttatacaccacattgtctttatccattcatgcagtaatggacatttaagtttttaaattttgttttttgtgagtaatgctgcaaagaacaggggtatgcaggtacctgtaccacatcctgatttccattcttttggacatatgcccaagagtaagatggggggtcatatagtagttttaattttagtgtttttgaggaacctccatactgttattcacagtgactgaaccaatttacatcccaatttacagagagtgtacaaggattccagtttctccccatcactgctaacacttgttatgtcttgttttgttttataacggctctcctaatgggtgtgaagtgatatcatattgtggctttcattcgtatttctctgatcattagggatgttgaacatattttcatataccttttggctatttgtatgtctttgaagaaaatttattcaatcattttgcccccctttttattttttctgttgttgaaggagttccttatatatgtaatgaggtttttagaataaatgaatataagtttaatatagtaaaaacattaatacaatttttatttttatgtttaatacattctgtgctccagaaaaaaatatcattgtttatctcacccaagatcattatgatgttcctcaaagttttcttctagaagctttagcattcatgcttaggtgtgtgatccatcttacattgaattttgtggatgatatgagtaagatattaagattaatgaaaatgttaattataataggttctcaggtcctagccaaaggttttgtatattaggatctcttgagatctaggttatttaaaggtaatagacaataagtattaatgaatttgttttctttatctatctggtggttcttaaactttgttgcatattagaatcaagtggtttgcttgcttgctttgttttgtcttgcttttaatagcactgccccaatcataccttcaaaaattctaatttgataacctggacatcaggatttttggaggaggaggggacagggtctcactctgtcacctaggctagtgtacagtggcatgatcatatcccacttcagcctcgaactcctgggcttgagggacccttctgcctcagcctctcacgtagcttgaattacaggtgttgagccaccatgcctggtgacattgggattttaatgggtctctgggtgagtgaatataaagtcatgtttaggaatcattgacaagctccagaagcctggaaaaatgtattcatgaagacagaggttagtgttactgtctccttggatgaaaacacctgacaagatttaggtatttatttattgatttattgatttatttattgggaaacaacattggaagcagtttctgatctgcctctttaatcccttggccaatgcaatcttgagttctttgtagtctcaccattaagtcttgtagggagaatacatctttacttcaagttttcatgcactttatcttcatcttggagaattattatttgaaaaaaagttctcaatatataactcatattaagtaaaatatgtataatacattgcaataattcaacaaatattgcttgtgatgttgtacttactttacacttgtgaaaaatgtaagcaaaatttttaaatagtattacattattttcatagaagaatcacagtaaaataagaactctacaagtccatattttactaagttgcattatttgaaaagcaaactaattttgaagtatctgatgatttcaaaacacagttcactattatttaattagaggatttgaaatataatttttaacattgacttagatactttcctgaaatctattagacataaaagtaaatggtatttatacatttgtttgtaagatgctatgattttaaatttaaaagtctatgtagctttttctgaaggaagctgttctacaattgtagaagcaattttggggcatttctcttacttgattgacttttttcttatccagatgctaccaattttcaagcttgcacaaagtccacttctatgagggaactcagcctacaaggctgtcatgtacatcagtaacatctatatctttatagtaccacatacgccttgccttatcaaatgaaattatataccacgaagtcaggatcgtatctcaactgttctgtaaactccacaatgcatagcatagtgtcactcatgggaaaaatgaaatacttgtgattgaaatggattaacattcttctcatgttaaggaacgtacttcttttattgtacctgttgttatgcagggtgtaagatttattattttctccagaattgatatcaataattaaaaatatataaaaattgaagataaatggggaaacgaacaatttatgaaggtcaaaactatgaagtaaatttcagttcatggatatttggtagaaatactaggttggagagtatggttcacatttgagaccaaattaaatattatttaatagatttctttcatacttagttgaaggaaagcatgtaataaaaacctagcttgaccaaaaacctgacttgctcttggcaaaaattgtggtgtagagagagagaaagagagagagaaggaagtaagaaaattaataacctctactctgtgggaaagtcgttccattccaaatgacacaaatagagaatctgatgaatccgagcctaagaaagtcgaaaaggaagcagattggtatctaatcattgaagacaataaacctgaacactaaaaagacatgactaaataaatgtcaggttctgaacaattaaactggttacttctcttacattgaagtaaagagagactggaaatttctgcctcaactctccctatcaactcaataccttagagtcgaacatagtgttccaaataaaaatataatgaggcagaagatgacaccttgtttactaaattttctagttcatattgaatagttccatctgagcttgaaagccaaggtcttggggaaccatttttaatgtgcttttcaaagagctcatattaaaataattactttatatgtaattagcaaataattagatatgaggctcacaaaggaaatatttatgttcatataatatggctaatgtatggtaacaatagtattaaatctatagatctatgatgggagaattactagaaaaacaatagtgggtctcccaatccatgagcatggaatgattttccatttgcttagatgattagttttcagcatacaaatcttacacacattttgctacatttatttccaagggtttatttttatagtattgtgaatataattatttcttaatttttttttaagagagaaagtgtcttgctctatctacctggctggagtgcagcatcttgcaatcatagctcactgcaaccttgaactactgggctcaagcaactctcctgcctcagtctcctgagtacctaggactgaggtgaatgccaccaagcctagctaattaaaaataaataaatacatttgtaaagaagatctctgtttgttgcgcaggctggttttgaactcctagcctcaagtaatcctcctgacttgacctcccaaggcactgggattacaggcctgagctctttagcccagccacttccatttcctgatggttttatcaatgtattcttcattgtattgactataatctccagtgcaatattggatagaattggtgagagtgaacattataaacatctttggcatgtcgccaattttgaggggaaaacatccagtctttcaccattagatgtgctgtaaaacacagtgtttttggtgattgttgttgctgatgtcctctatcaggttgaagaaattccattctatttttttattcatgttagattctgtcaaatcattttcctgcatcattgagataatcgtttcattttagttctttattttacaacataatatattacattatttactttttaaatactaaaacaatcctgcatttctgggattaatttcacttagttatggagtgcaatcatttgtatacatggttgaatttagtttgataatattttattggagattttcgtgtctatatttgtgaggtatactgatctgtaattttatttttattttttcttttttaaaatttctttttctttcttctttcatttttgcttttgaatataggccttataacatcaattgggaagtttttctctttctctattttctgagtatgagtatcatttcttcattgactatgtgaaataatttaccagtgaagtcatgtggtcctgtatattctcttatggaagacttttaattgttaattcaacatatttattcagattttctattcatgtttgtttcagctgtggtaatttatacatttttaagactttctaccataaatataagttgtataatttgtggtcacaaagtatttaatagtatttcccttataattcatacatttggacaggatgggggagaattggcagtagtaacctttgttcctgattttggtaatcaacactttatctcttatttcttttcttttttgagacagagttttgccgttgtcacccaggctggagtgcaaaggcaggatctgggttcactgtaacctctgcctcctgggttcaagcgattctccttcctcagcctcctgagtagctgggattacaggtgcccaccaccacgcccggctaatttttgtaatttttggagatggggtttcaccatgttggccaggctagtcacgaactgctggcctcaagtgatccatctgccatggcctcccaaagtgttgggattacaggtgtgagccaccatgcctggtcttttttattattcatcatctaaatatttctcaattttgtttaacttttcaaagatttagattttggatcattaaatttctttgttttttgttttcttttttctgttatttttttttagcataacatttttatttaaaaaataactattttccacaagaacaaaagtgtagcgagaggagtggtgataaaggttacatcctggcgagtctctctaaggtctggctagcagaggattgctgacttctcatacctgcttctgcattcaccctgctgctaccacacccttatgtagtctctggaaaactccactgtgttcttgtgacagaatgacagtaaaaatggcaaaaacatttattaaggactgaattctatcccccacaccacccaccgaaatttatacactgaagtcctaacccctggtgtgactctatttggagtgaagatttaaggctaatgaggtcataagagtggaatcctggttccatacaattaatgtccttataagaagagacactggagagcttctctctgccatgtgaggccacagcaggaagacagccatccacaggccaggaagagagccctcactaggacctacaacgggcaaacacctcgatttggaacttccctgcctccacaattgtgagaaatcaatgactcgtttaagccttttttttttaataggatttgagattggttatattaaggtaacaatggaaacatgaatacaaaattaatccacacataggaaaaaggaataatacataaaccactgaggttgctaataataatgatgcctgtttccaaggcaagtgaatacattatgagaccactgaagtgacttttagttaccttgcttagtgcctctgtctttttttttcctttattattattattattatacttttaacttttagggtacatgtgcacactgtgcaggttagttacatatgtatacatgtgacatgctggtgcgctgcacccactaactcgtcatctagcattaggtatatctcccagtgctatccctcccccctacccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaattacatccaagtccctacaaaggacatgaactcatcattttttatggctgcatagtattccatggtgtatatgtgacacattttcttaatccagtctatcattgttggacatttgggttggttccaagtgtttgctatcgtgaataatgccgcaataaacatatgtgtgcatgtgtctttatagcagcatgacttatagtcctttgggtatatacccagtaatgggatggctgggtcaaatggtatttccagtactagatccctgaggaatcgccaaactgacttccacaatggttgaactagtttatagtcccaccaacagtgtaaaagtgttcctatttctccacatcctctccagcacctgttgtttcctgactttgtaatgattgccattctaactggtgtgagatggtatctcattgtgcttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttgtcttttgttcccattgcttttggtgttttatacatgaagtccttgcccatgcctatgtcctcaatggtaatgcctaggttttcttctagggtttttatggttttaggtctaacgtttaagtctttaatccatctggaattgatttttgtataaggtgtaaggaagggatccagtttcagctttctacatatggctagccatttttccctgcaccatttattaaatagggaatcctttcccattgcttgtttttgtcaggtttgtcaaagatcagatagttgtagatatgcggtgttatttctgagggctctgttctgttccattgatctgtatctctgttttggtaccagtaccatgctgttttggttactgtagccttgtactttagtttgaagtcaggtagtgtgatgtctccagctttgttcttttggcttaggattgacttggcgatgcgggctcttttttggttccatatgaactttaaagtagttttttccaattctgtgaagaaagtcattggtagcttgatggggatggcattgaatctgtaaattaccttggacagtatggccattttcacgatattgattcttcctacccatgagcatggaatgttatcccatttgtttgtatcctcttttatttccttgagcagtggtttgtagttctccatgaagaggtccttcacatcccttgtaagttggattcctaggtattttattctctttgaagcaattgtgaatgggatttcactcatgatttggctctctgtttgtctgttattggtgtataagaaggcttgtgatttttgcacattgattttgtatcctgagactttgctgaatttgcttatcagcttaaggagattttgggctgagacaatggggttttctagatatacaatcatgtcatctgcaaacagggacaatttgacttcctcttttcctaactgaatacactttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatggcttttattattttgaaatatgccccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgaccacggtggataagctttttgatgtgctgctggattcgttttgccagtatgttattgaggatttttgcatcaatgttcatcaaggatattgatctaaaattctcttttttggttgtgtctctgcctggctttggtatcagaatgatgctggcctcataaaacgagttagggaggattccctctttttctattgattggaatactttcagaaggaatggtaccagttcctccttgtacctctgttagaattcggctgtgaatccatctggtcctggactctttttgttggtaagctattaattattgccacaatttcagatcctgttattggtctattcagagattcaattcttcctggtttagtcttgggacagtgtatatgtcgaggaatttatccatttcttctagattttctagtttatttgcatagaggtgtttgtagtattctctgatggtagtttgtatttctgtgggatcggtggtgatatctcctttatcattttttattgcgtctatttgattcttctctctttttttctttattagtcttgctagcggtctatcaattttgttgatcctttcaaaaaaccagctcctggattcattaattttttgaaaggtttttttttgtgtctctatttccttcagttctgctctgattttagttatttcttgccttctgctagcttttgaatgtgtttactcttgcttttctagttcttttaattgtgatgttagggtgtcaattttggatctttcctgctttctcttgtgggcatttagtgctataaatttccctctaagccaaaagaacaaagctggaggcatcacacttcctgactccaaactacactacaaggctacagtaaccaaaacagcatggtactggtaccaaaacagagatatagatcattggaacagaacagagccctcagaaataacgctgcatatctacaactatctgatctttgacaaacctgagaaaaacaagcaatggggaaaggattccctatttaataaatggtgcgggaaaaactggctagccatatgtagaaagctgaaactggatcccttccttacaccttatacaaaaatcaattccagatggattaaagacttaaacgttagacctaaaaccataaaaaccctagaagaaaacctaggcattaccattcaggacataggcatgggcaaggacttcatgtataaaacaccaaaagcaatgggaacaaaagacaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaaccctatcaaaaagtgggcgaaagacatgaacagacacttctcaaaagaagacatttatgcagccaaaaaacacatgaaaaaatgctcatcatcactggccatcagagaaatgcaaatcaaaagcacaatgagataccatctcacaccagttagaatggcaatcattacaaagtcaggaaacaacaggtgctggagaggatgtggagaaataggaacacttttacactgttggtgggactataaactagttcaaccattgtggaagtcagtgtggcgattcctcagggatctagtactggaaataccatttgacccagccatcccattactgggtatatacccaaaggactataagtcatgctgctataaagacacatgcacacatatgtttattgcggcattattcacgatagcaaacacttggaaccaacccaaatgtccaacaatgatagactggattaagaaaatgtgtcacatatacatcatggaatactatgcagccataaaaaatgatgagttcatgtcctttgtagggacatggatgaaattggaaatcatcattctcagtaaactatgacaagaacaaaaaaccaaacaccgcatattctcactcataggtgggaattgaacaatgagatcacatggacacaggaaggggaatatcacactctggggactgttgtggggtcgggggggggagggatagcattgggagatatacctaatgctagatgacgagttagtgggtgcagcacacagcatggcacatgtatacctatgtaactaacctgcacaatgtgcacatgtaccctaaaacttaaagtataataaaaaagagaaaaaagaaaccccccccaaaaaaagaaagagatatttattccttctatattttcctataaactcaaaagcctattaaaatgttaactatatggaaaatacataatacatactgatgacaaatttatttataataaaaatatcttagtatctttatatgtggatgatattgacaaagtttttctctttagttattttacaattgacttttaaaatgtcttgttattcagtaacgtctctaagtgctttccaacaataactgagaaaaataggtgattgaaacttgagagtttcacaggcttagtctacttctgaggtgagatgagaagccacagacagactatctctcaactatgatagtaatcttaattgatctcagaattttgctttactaggtcttaagcttattgttctttattacccattatttcacactttgcaactgactgggcattttgccagtgatcacaatgaataaaatgtggcttcagcggcctattactgtgctcaatgtctttgcaagttgctggcaaacatgattttattttagatactgttatatgaagtaattttttaaaatttatagtttgccaatttattcataaatttcttagtatcattttcattattaacacatttacataccgtgcttcacacttacctgtaaaatagtgaattctacatcaaaagtatttaacgagaacactggtggatgaagtgactatacttccaaagcaaaatcatctctttttaattcatcagcttagacggagaatgtttaatgttacttgtaaataatggactaacaaaaatccactaaccctaccttttgtgtttttatatgcaaaatagagttgtgttagactgtcttgaaattgactgacctgctctatataaaggcttgaggtgatcaggaatactctattctaaggatatgggagttttgacaattataatatccagaaaatataatatccattcatacaatatgaatggggaatgcaggtgtacttgtttatatatatatatatatatatatatatatatatatatatatatatattctattcatgtatacacattctgtgttactttctgtgttagcctgccacagtgtcatgaatgctaggagaagatacaggacccctggttcatggacaaagactttatttctcaaggcacagcaaggggcatgagttactcattcttattgttccttttaccccaaaagtctaacaagacaaagtagagggacctgagtagatactacacacagtggatttacatcagagcttagctactctaggctgaaggagcccaatcattttatcatgagatataagcaaacctccccaggatttgccttggagggagacatctttattaccaataagtaagaaaatatattcttgctttaaaaggggatactttgtctttcagaattgttctctacacaaagatcctttaaaagggagcctagtgcagaataacagttgtgcagaaatgcaaaagacacttggaggactgtctcctaacacctatcaaatgcagagtactacattaggtatcagggaaagaaagatgaaattatttgggctgatggaaatcagcagctcacttaaaagaagcatgagtggaaagttagttatggtaacgcaggagaggaagtgataccataatgtttaaaacagggagacatttagccaagtctaggaggtcagggagtacttttcaaagttaatacctgataagagttttgatgtaaattttctaaaaacgcttctatgtagctgtatctttcttactttcttaggggttctaggttatacaaaagtcaagaatttcaaggctttttattaaaaattgctcaacatatgtttctaagatttgtttgctaccagtagcctcctttagccaaaatttcataaggtttcaagattatataaagataatgaaaactaatctgaattagagtttttgcttaattagtaggatcttggaaattatcttgaagaatataagaagattttaataataattttatgtgcaaactcttgcccataacaataatgttttataattttatctccttctcatctcacttgaatatgcaatgttcaactaaaatcacttataaaagaagcaggaatatgggaatatttagcctttggggaatcttatttcctatgttgttgactatggcctccaaggaggaattttagatccctatttccctgcaagatgatctattatggtggattataacttctatgtctcattttatctcataatggataaagaaaacttggcacatataccatggaatattatgcagccataaaaaaaggatgagttcatgtcctttgcagggacatggatgaagctggaatccatcattctcagcaaactaacacaggaacagaaaaccaaacaccacatgttctcactcgtaaatggggctcgaacagtgagaacacatggacacagggagggaaacatcacacactgtggcctgttgggggttgggagggctagggtattaggagaagtatctaatgtagataatgagttgatgggtgcaacaaactctcatggctcatgtatacctatgtaacaatcctgtatgttctgcacatgtatcccagaagttaaagtataaaaaattccatatttttatattttgatgtacatattataccagtatagttatatatgtaaaaattttaagggtaaatacatataaaacatatattagtctttgatcagaattgtattaccaatataaataagaatatcatttagaatataaaattcctgattctgcaacaaatgacttaatattatcaatattaatcataattatttaaatgctttttagctgcccatcaccatattaataataggaataatgacagctaattttaattgagtacttcctaaatgtggcccagttacagtaaaacaaacactattagatacaccccatcaatcattacagcaagtctatgaaacatactgcattactaagtcaatattagaaatgaaaaactcatgggaaggatatgtataaaacttgctcaaagttacccagctaataagaggctaggacaagattaaacatctatgtagttttctttcctgagctgaagttcctaaatccttggctgcatggcgcctcattcaaaagtcctaaattggctaaaatatatataacagaaaattcacagaatcatttccttctacttgtccactaccagggctgttaacagtcccaagcaaaaggacaaaaattttttctacttgagataagaaaaatatacagggtgacagaaggtgttctaccaatataaaaacactttaccaggaaaattgagaagagggctgttaacctttggggaaatgtaggccttcagtggattcttgttagaaacataaagatgtagagagaagattttcatttaaaagcctcttccattcagcaaagtatattctgaatcctttatggtattaggctcccatatagttacaagtaaccccatgtggttttagaattcttaaatattcgcacacatagtcatctgaagaatgaataaatccatgaatgactaaacagagtttattcccatatcattttcaatatccctaaattatgcttacatccttaaatctgttacttcattctcaaagcacatagtctgtaactcataaaaataaactcctgttggccaggcacagtggctcacgcctgtaatcccagtactttgggaggctgaggtgggcggatcacctgaggtcaggagttcctgaccagcctgatcaacatggagaaaccctgtctctactaaaaatacaaaattagccaggattggtggcgcatgcctgtaatcccagctactgggaaggctgaggcagcagactcgcttgaacccaggaggtggaggttgcggtaagccaagatcaagccattgcactccagcctgggcaacaagagcgaaattctgtctcaataaataaataaataaataaataaataaacaaacaaacacctgtcttcctagtgttttatgtctatagttcagaaatgctttacctacttcatgatgtgtagtttgttctgatctgttccttttcttcattgtgtctagcctcataagtcatcttcctagttttggaataacctaatcccgtaaggtcattgctaatgtttcagctttgaataatttcctattttctgccctatgtattgaacccttctgttaattatgctgtctttaatatatcttacttgctttgaatagacttctgtaccattctacttataggttgttccagccaaactcattctaaataggtcaggcatggcctaaacattctaaataggccaggcatggtggctcacgcctgtaatcccagcactttaggaggctgaggtgggcaaatcaaaaggtcaggagttcgagaccagcctggctaaatgttgaaaccccatctctactaaagatacaaaaaattagccaggtgtggtgacttgtgcctgaaattgcagctactcaggaggctgaggcagttgaattgcttgaacacaggaggcagatgttgcagcgagccgagatctcaccattgtactccagcctgggtgacgggccgatactccatctccaaaaaaaaaaaaaaaaaaaaaagtaaagaaaaacatttatgaaagtgtgcacaacaaaattaaaatgttgactctaaagtgagcaactgaatgactgggatgcataagagaaaagggtacttaacatttttatacctattgaattgtatcctatgtacgtattataaatttaaatgtgcaataatgcagataactgaaatgtgggtatgctttgattaggactttgcatttcccatttgctcaaactcctcatgattctggatgcatatgaatagaaatacaaaatgtaaggggaccgaggacttctcatagccctttcttctttccacattttgtgtctctggctgtagtttgccatatgagtctatatggctaatgagcaaaatatttttcagatggatacctgtgaccaagcattgcattttaaagatatttctgaatcttggacctcttatttacagtgaagccccctcatgcatagtaaagcagacaggaatgtaaaaggttgctgcatcgataatcaatttctggtgagcagtaattataggtaatgtaaacagggacaattattgcttttcatcatatcttgagagaaatcctacagccaatgattttgaaaaaaataaaacatctaagttcactcttttctataatgaaaagacattatccagtagaagttcaagagtacagtctgaaggcagcttatctgacctggccacatggtcttgccactttagttaaagacaacttcctacacagtaacctctccagacctcagatcctcaactctctaaaatggaaacctagtagtatttacctctagaactgcagctgaactgagcattttaggaaaggaacaaacacacacacgatatatataatcagattatgaacgcagtgtggcccagagtgcaaaaatttctcagtactagagattctcaagagaaaaatgagatgtagtctatctcagtggcctttcatgtggcaaatgaaaagtgaaagtccataatgagaaatacatgggcagccagtgacaccacccattcaatgtagactctcaacatctctgacagtcattacctgttgtaccctgacctgcttatatattggggtaatatcaccttttgatcaaaacatacataaacctcaagcctcagtaagaaatatttatggacaaccagattttctgtgtttccagtcaaaactcaggtagaccacattttatgtgacaggagaaggcacagttgatgcccagttaaccctgagatcatctctgcctgcagcttcctatcatcatagcaagctctttccctgaagtacatcatctgtatctgctctttgctatataagtagcaaaaataagcatctgaaaagatgctcagcaccatatgtcactggggaattcaaattaaaacaacaatgagataccactacacatctattagactggcttaaatccaaacgctgacaccatcaaatgctggtgaggatatggagcagcaggaacactcattgattgctgctgggaatgcaaaatggtaaagccactgtggaaggcagttttgcaaattcctgcaaaactaaacatatgcttaccataagatctggcaattgcattctttggtgaatactcaaatgacctgaaactttatccactgaaattctgcacgtgaatgtttaaagcagcttatacatattcgacaaagattggaagtaaccaagatatcctacaatagggaaatggataaactatctctgaaacattcatacaatggaatattcttcaggaataaaaagaaactaccaaggcatgaaaagacttggaggaatcttaaacacgtatttctaagtgaaagaagccaatgtgaaaaggccacatagtgtagagttccaattatatggaatactagaaaaggcaaaactaggcagatggtattataaaaagttcagtggttgccaggggcttgagcaaagggaaggatgaataggtggagcacagaagatttttcgggcagtgaaacttttctgtgtgaccctataatggtggatatatgtccttaagcatttgtcaaagcccataaatggtagaacacaaagaatgaatgttaatataagccatgaacttaataatatcaatattggctcatcatgcataacaaatgtaccacattaacaagatgataatagaggaagtgtgtgtactatggtgtgaggcagatattagagcacaataggccttctgctctatttttctgtacgcctacaactgttctaaaaattaagtcaattatttatttatttattatttattaatttattttttgagatggagtctcactctgttgcccatgctggagtgcaatggcacgatcttggcttattgcaacctctgcctcctgggttcaagtgattctgctgcctcagcctcccaagtagctggaattacaggcacccagcaccatgcccggctaatttttttgtatttttagtagagacagggtttcaccatgttagccaggatggtcttaatctactgacctcgtgattcacccaccttgccctcccaaaatgcttggattacaggcatgagccaccgtgccaggcctaatttatctttttgagacaggttttagctctgtcactcaggctggagtgcagtggtgcaatcatggctctatgcagccccaacctccagggctcaagtaaccctcccacatcagcctcctgagtatctgggaccacagggatgtgccaccatgcctggcacatttcttagacctctgaaaagatgctcaacaccatatgtcactaggaatattcggtattcaactagaggcttcaatgggctctgaaatatcccctggtaaactctataaatgtgtttccaactggctgaatgaaaacaaaggtttacatctgtgtgagatgaattcacatatcagaaagcattttcactgagaacttttctagttttatagcaggatgttcgttttttcaatattggtctcaacgggctccaaaatgtccctttgtacagtctacaaaatgttttgccaacatactgaatcaaaacaaatgtttagcactgtgagatgaattttcacatcaccaaacatttttacagatagtttgtgtctagtttttaatcacaaaattttgaatttttcactgtaagcctcaaagggctctaaattgtcccctcttagcttctactaaaagagagttttgaacctactgtgtagaaacaaaagtttaactctgtgaaatgaattcccacattgcaaagctatttcacaggtagcttgcttctagtttttatcacgaattatttggcttttcactataggcctcaaatgggctccgaaatgtcccttcatacattctacaaaaagagtgtttccaacttagctgaatcagaggaaagtttaaactgtgtgagatgaaactgcaaattgcaaagcattttcacatatagcttctatagtttctatcagataatattcagtttttcactataggcctctgtggactatgaaatgtcccttcataggttatacaaaaaggtgtttccaacatgctgaatgaaaataaagatttaactttgtgagatgaacccacacatcacaaagcatttttatagatagattttctctagtttttattgcagaatattcaatttcatactataggcctcaatttgctccaaaatttcaccttgtagattctacaaaaagaatatttccaacccgctgaatcaaaaccgatgttcaattctgtgagatgatatgcaaagctttttcacagatatcctgtttctagtttttatcctgtggtgtttggtttttcactataagcatcaatgggctctgaaatgtccctctgtagattctacaaaaagagtgtttccaacctgttgaatcaaaacagttttaactttgtgagatgaagccacacatcacaaagcattttcacccatagcttgtttctaatttttaccatgggttattggtttttcactaaatgcctcaatggactaggaataattgccttgcagattgtacaaccaaggagtttccaacctgcagaagcaaaacacaggtttaactttgtaagatgaatctacacctcgcaaagcatttttacagataggttgctttgagttttcatcaagagatatttgattcttcactgtatgcttcaatgggctatgaaatctccccttacagattctacaaaaaaagtttccaaactgatgaatcaaaagaaaagttcaacttttgagatgaaatcacacatcacaaagtattttcagaaatagcttctttatagtttttatcacaggatattagattttccaatattagggtcaatgagctctgtaatgtccctttgtagattgtacaaaatgagtgtttccaacctatggaataaaaaggaaggtttaactctgtgagataaatccacacatcacaaagcatcttcacagatggcttgtttctaatttttattgtgggatattctgtttttcactaaaggcctcaagcgctccgaaatgtccctttgtagattctataacaagagtgttttaaaactgctgaatcaaaacaaatgtataaccctttgagaggaatccacacatcacaaagcatattttcagatacttgtttctagttattaaagcaagatattcagtttttcagtatatgcctcattgggctcagaaatgtctcatagtagattttgagacatagtagattttgaaacacaaaaatagtgtttcctacctgccgaatcaaaacaacagtttaaacctgtgagatgactccaaacctcgcaaagcattttcacagatagtcgtttcctagtttttatcacaggatactcggtttttcagtataggcatcaatgaactctgaaatgtccactcataggttctataaaagtgtgttcccaactccctgtataaaagcaaaggtttaactctgtgaaatgaatctgcacattggaaagcattttcacaaatagcttgtttctagcttttatgatgagatatttgattttttactattggcctcaatgggctcagaaatgtctctttgcagattctaaagaaaaaaggtttttcatttttctgaataaaaataaaggtttaactctttgctgtgaaatcacacatcacaaagaatttttacaaacagcttgttcctagggtttatcactggatattgggtttttcactataagcttcagtggagacttaattgtaacttaattcacaaaaagagtgtcccccaacctgctgtatgtaaataaaggtttacctctgtgagataaatcttcacatcacaaagcattttccccgatagcttttttctagtttttatctcgggatattgatttttcactataggcttcaatgggttttgaaagtttcctctgtagattctacaaaaagagtgtattaacctgctgaatcaaaacaacgtttaactttttgagataaatccacacatcataaagcattttcacagatagctctttttttttttttttttttttttaagatggagtctcactcagtcacccaggctggagtgcagtggtgtgatctcggttcactgcaagctccgcttcctgggttcatgccattctcctgcctcagcctcccaagtagctgggactacagatgcccgccaccaggccaggctaatttttttgtgtttttagtagagacggggtttcaccatgttagccaagatggtctcgatctcctgacctcatgatccacccgcctcagcatcccaaagtgttaggactacaggcgtgagccaccgcacctggccgatagcttttttaactttttattttgggatattggtttttcactacaggctgatactggcttcaaattgtaccctcatagattctacaaacagtgagtttccaagcatctgaaatgctagatattcggtttttcactgtaggcatcaatttgctctgaaatgtcctattgaagattttaccaaaagagtgtttccatcctgctgaatcaaaagaaggtttaattctgtgtgatgaaattacccatcgtaaatcattttcagagacagcttcatatagtttttatctcagaatattccgtttttcactttaagcctcaatgggctttgaaatgcctcctcataaattgtacaaaaaaaaggagtttccaacatgttgaatcaaaacaaatatttaatgttgtgagataaattcaaatatcgcaaagcatttttacagattttttttctcatttttatcgcggaatattcggtttttcactagtcctcagtgggctcagaaatgccccttgtatgttctacaaaaagaatgtttctaacttgctgaaccaaaacaaaactttaatgctttgaggtgaaaccacacattgcaaacattttcacagatagcttgtttctagttttgatcacggaatattggatgttttacaataggcctcaacgtgctaagaattgtcccctcttagattctactagaagagtgtttccaaaatgctgtataaaaataaaggcttaacactgtgagatgaactgacacatcacaaagcattttcacaggtaggttgtttcaacttttcatcatgtgatattcagtttttcaatatattcctccatgggctctgaaatgtcccttcatagattctatgaaaagactgcatccaactgactgaatcaagacaaaggtataactctgtgagagaaatgcacacatctcaaagcattttcactgatatcttgtttctagtttttatcatgggataatttgtttttgactataggcctcaatgggtttcaaaatgtccctttgtagattctacaaaaagagtgcttccatcctgctcaatcaaagcaaaggtttaattctctgaaatgaatccacacatcacaaatcattttacaatatagcttgtttctagtttttattgtgggatatttgattttttactttagacctcaatgggctctgaaatgtgccttcttagattctacaaagagagtgtttctcacctgctgaatcaaaacaaaggtttaattttgtgagataagtccacacatcaccaagcatttttataaatagcttgtttctaatttttatcatgggatattcagttttttcagtgtaggcctcattggtctctgaaatgtcccctcatagattctacaagtagagtttttgcaacctgatacaccaaaacaaacatttaattctgtgagataaatctataactctacacgtctgaaagcattttcacagatagcttgtttctagtttttatcacaggatatttgatttttcactatagacctcaataggctctgaaatgtcccctcaaaaattctacaaaaagagtgttttcaacctgctgaataaaaacaaagttttaactctgaaaaataataaatcataaaacattttcacagttggcttgtttctagtttttatcacgcgatactcagtttttcatgacagggcacaatgggctccaaaatgtccctttgaacattctacaaaaagagagattttggcctactgaataaaaacaaaggttttatactgtgagaggaatccacacataggaaggaattttcacagatagcttgtttctagttttcaacacaggatgttcaggtttttcatatacttcttgatgggctctgaaatgtcccttcatagactctacaaagacagcatttacaacctgctgaataaaaacaaaggtttaacctgtgagttgaatccacacatcacaaagcattctcatatatagcttgtttctagtttttatcttgagatataacgtttttaactttaggccttaatgttgtctgaaatgtgccattttagtttctacaaatacagtgtttcaacctgctgaattaaaacgagatttaactctctgatatgaattgacacatcacaaactattttcacagatagctttttactagtttttgtcatgggattttaagtttttcactaatggctttcatgtactctgaaatgtccctatgtagattttacaaaaagagtgtttccaacctactgaatcaaaacaagggtttaaatctgtgagatatatccatacattgcaaagcactttcacagattgctagtttctagtttttatcatgagatacttggtttttcactatagacctcaataggctcccaaatgactctcatagattgtacaaaaagagtgttttcaaagtgctgaatcaaaataaagatttaactcagtgaggtgaatccacgcattgcaaaatattttcacagatagcttgtttttttttttgtttgtttgttttgtttttattgtgggatatttcatttttcactacaggcctcaatgggcaccaaaatgtcttctcctagatcctacaaactgactgtttccaacttgcttaatcaaaacaaaggtttaaccctgtgatatgaatacacacatcccaaaggattttcacagatagcttatttctagtttatatctccacttattttgtttttcactgtaggtttcaatgggctttgaaatgtttctttgtagattctgcaaaaagcttttcaaatctgccgaattaaaacagtatttaactctttgagatgaatccacacactgcaaagcattttcacaggtagctttttttctagtttttatcatgggatatttggtctttcactgtagtagtcctcaatggactctgaaatggcccttagtagattctacaaaaaagagtgtttccaacctgctgaatcaagataaatgtttaactctatgaaaggaatccacacaatgcaaagcattttcacagatagcttgtttgtggtttttattgcaggatatttggtgttttaatgtacttgtccatgggctccgaaatgtctcttcatatattctacaaaaatagtgattccaacctgctgaaaaaataacatgtgtttaactctgagagatgattccccaaatcacaagacgttttcacagacagcttgtttctagttttcattgtgggatatttaacttttcactagaggtcttaatgagctttgtaatgtccttttgtacaatctacaaaaagagagtttccagtctgctgaatcaaaacaaaggtttaaacctgtaagatagatccacacattgcaaaacattttcacagacatcttgtttctacttttcattgtagcatacttgctttttccaaatacttctccaggggctccatattgtcccttcgtaaattccacaaaaagagtgtttccaaccagctaaatcaaaacaaaggtttaaatctgtgagttaaatctatgcattgcaaagcattttcacagatagcctgtttctcatttttatcatgggatatttggtttttcaccataggcctcaatgggtactaaaatgtcttctcatagattctaaaaacagactgctttcaacctgcttaatcaaaagaaaggtttaactccatgatatgaatccacacattgcaaagcattttcacagatagcttgtttctagtttttttctccacatattttgtttttcactataggcttcaatgggctttgaaatatttctttgtagattctgcaaaaagagtttttccaccctgtgtatttaaaacactggtttaactctgtggcatgaatccacaatggcaaagcattttcacagatagcttttttcttgtttttttttttttttttttttgggtggggtgggggcgatatttggtctttcactgtaggtctcaatgggctctgaaatggcccttcatagattctacataaagagtttttccaacctgctgaatcaaaacaaatgtttaattctggaagatgaatccacacatcacaaagcattttcagatatagacttttattgtttttattgtgaaatattttgttttttactataggcatcaatgggtgtgaaatgtccattcatatattctataaaaaagtgttttcaacctgctgaataaatgcaaaggtttaaatatgtgagatgcacccacacattgcaaagcattttcaaagacagcttgtttccacttttatcctgagatattttgtgtttcactatgggcctcaatgggcttcaaactgtccctttgtagattctacaaaaagagtgtttccaatctgcttaatcaaaaaaatgattaactctgtgagatgaatccacatatcacaaagaatttttactgatagcttgtttctggatgttatcacgggataatcggttttttatcaacctgctgaatcacaagaaagatttaactctgtgagatgaaatcacacatcacatataactttcagacacagctttttgtagtttttatcacagggcattaagtttttcactacaggcttcaatgggctttgaaatatccttgtgtagattgtacaaagagagtgtatccaacctgctgaatgaaaacaatatttaattctttgagataaatccacacataccaaagcatttttacagataggttgtttccatttttcatcatgagatattggggttttcactataggtttcaatgggctctgaaatgtttcttcatagattctagaaaaggagtgtttcaattcgattgaaatgagtgttctgattctgctgaatcagaaggaagttttaactctgtgagatggatccacacattgcagagctttttcacagataccttacttctggtttttttcatgggatatttggtttttcactataggcctcaatgagctccgaaatgtttttatgtagcatctaaaaaaagagtttttccaaactgatgaattaaaacaaaggtttaaatatgtgacattatttcacatatcacaaagcattttcacagataccttgtttgtagtttttatcacaggatattctgcttctcactataggcctcaagggtttgaaatgtctttccttagatttatgaaaaacatgtttctagcctactgaatgacaaatgtttaactctgtgagatgaatccagacactgccagtcgttttcacagatagctgtttcctagttttgtgtgtgggggatattcgctttttcacaatatgcctcaaaggtctcagaaattcccattagtagattctacaaaaagagtgtttccaacatgctaaataaaaaaaaaactttaactctgtgagaagaatccacacatcacaaaatattttcactgatagcttgtttttagttttcatcgtgtaatatttgttttttgtttttgttttttgatttttgttttttactataggccccaatgagctctgacattttttctttttagattcaacaaacagagtgtttccaacctattgaatcaaaagaaaggtttaaatttgtaagatgaatccacacatcgcaaagcatattcacagatagcaagcttctagtgtttttttttttttctgcaggatattctgtttttcactgtaggcctcaatgggctctgacatgtttgttggtagatactactaaaagactgtttcaaacctgctgaatcaaaataaaagtataactctttgagatgagcccacacatcctaaagcattttacagatagcttacttctagtttttatcacgagatattctgtttttcactatagacctccatgggctccgaaatgtccccttgtagattctacaaaaagaatgtttccaaattgctgaattaaaacaaaggtttaactgtgtgacattatttcacagatcacaaagcattttcacggatagcttgtttctagtttttattgcaggatatttggttttaaactctaggcctcaatgtgcttcaaaatgtctcatcttagattctacaaaaaacatgtttccaacatgctgaatcaaaacaaaaggttggctctgtgagataattccatgtctcacaaagccttttgacagatggcttgcatcaagttttcttcatgggatattccatttttctccataggcatcagtgggctccaaaatgtccctttgtagatactacagtgaaagtgtttctaaactgctgaattaaaacaaggatttagttttgtgagataaatccagacatcacaaagcatttcactgatagtttgtttctagtttttatcacaggatagtcagtttcttactataggcctcaatttgctctgtaatatcccctgttagattctagaaaaggagaatttccagtctgttgaatcacaagaaatgtttaactctgtgagataaaatcacacattggaaagcattttcagacatagcttctttgtagtttttatcgtggtatatttggtgtttcattataggcctcaatggattttgaaattttccctcatagggacacaaaaatgtctttatccttctgaatcaaaacaaagttttaactgaaaaaaaaaaatccacacatagcaaagcatttttaccatatctgccaagaaggaaactcttgttctcccaattttatcagaaggctgcctgattcctataggatgagaagcaggcagcggtgtctggatttgcctggtcatctaggctctgttacatatcatctgcatgttctttttcattgtggaggggatcttttatggatctgttgctagcggggactgcctctctttacagatcttttggctgccaggaatttcaaggagcaaaaagtactttgggtaggctggctgcactccaggttgtgagtagcggtctcactgtgggggactgagatgtttgcagtttgcaggaggcttttgggttctctggcaggaatccttgaacatggctttgactctagcacaggccctctcattctccaagggaagcattgattttccattgctttcatgaggagtccatactactcttcatcagcactcctaaacacactttttttggcttgcaattgcctcaggcggccactgagacgctctctgaactgcatctgcacctgtgaagtcagtccaaagtgtgagacttctgcttcactttgaacttgcctttgtcatggttcctgcctttcccaaagagccatgttgagaagcaggagcccctgtgaggcccaggatgaagggaggcagtgagctcaagggcccggccattttctgctgacatctgcctctggggtctcaggtatgatttcatcacctggacaccccttaacatctcagcagactgtattcccttcccccatgggacccgattcttgcacacagcctctttcgggaatggaatcggaagaacagtttctagctcccacctcagtctccaagtgcctcctcctccagcgggacctgaccatggagacagcccgaagaggcctgcatagagggttcgggggtgagtctttttgaaacttgccccctctgtgatgtctaagtacagcctgcctgtgttccccaggctgctctctcccaggaggggcttcctgcagaaacacacagcctctgaagctgctgggatgtgtgtttctttgggaatgtttcaagttgtggatatctgcgtgtgggtgcagacatgtgagtgtgtgtgtgtgtgtggggggtaagtggagtctgctgaaagaaatgtggctaacgcactgcagcactttgttttttgtcaccccaccttccggtggcctgtctctgtggctctgcttgggctgagggtctccatgttcttcatttttccatggctcctgagtccacagtaaattggaagaatggctgacaaccgccagggtcaaaatcacctccccttgcaaaaaaaccacatttctaaaaagaagagaagcacaccacaccccaaaacagacaactccccgtgctttattgttctgtggccagccctgggccagacccccgcagtccagtcgcagggctttttgaatttacctcgattttggtttgtagctgagcaggtgcttcaggtcatcaggaagcactcctccattgtctcggaattttattctgggatgcagagtgtgagcaacaataaggtcagataggggtgaggatacagtctgttgaggtatggatgggatctcgcaccttcacctcaaaaaaggtgcagacaaatgacacagaagttgcttctaactgcatcccctcattcccttcattgcacagtcaacagcatggcccggtgcccaggtgggatgactcaatcgtgcagagaaaagttggattgtaaactggggcccttcaggccagctccagaattgagctttcattcctggagccacattggagtgagacggattgatgctgggttggatgtggcctccacactggcctcctcttttcctgacttccatgtcccttgtgggcctagagtttcctaggtctggcttagagtttcttccatgttcctcatgaacctggggtttttaagggtctggctcaaagtcttccacacaaaaagtttctcagttcatggaggacgactctaatgggaatcaattgcatcagtgttttcttataaacactgtcatgttttaatgactgggcagttgtgatagttttggaatcgtaaattttgagtatatccacgatcaaggtaactcttgttctcccacttctaaaggacagctgcatgactcctgtaggatgagaaacaggcagctgtgtctggcttttacctggcaatctaggctctgtttcatgtcatctgcacttcctttctcattgtggatggggcttttcattgggctgttggtgggtgggactgcctttcatcgtggatgttttggttgccaggaatatcagagagcaaaaggtattttgggtaggctgcctgcacaccaggttgtgggtagtggtctcatagtggtggctggcattgtttgcactttgcaggaagcttttaagtcctgtggcaggaatccttgaacatggcttggactcctgcgcaagtctgctcattctcccaggaaagccttgatttttctttgctttcatggggggtccacagtgcccatcaatggcactcctggacgttattttcaggtttcaaattgccccagacagcctctgagacactctctcaacctcaagtgcacccgtgagaggcctgttagaggtgtgagaacactgctccaccttgaacttgcttttgtcatggtttctgcctttcccagagagccgtgctgagaagcaggagcccctgtgaggcccgggatgaaggaaggcatggggttcaagggcctggctgttttccactgacaccttcctcttggatctcagatatcccatcacctagagacctcttaacaactcaccagacattattcccatcctcaggagacccaattcatgcacacatccttttttgggaatggagtcaggagagcagtctccagagcccacctcacagtcttcaaactcctccttctcctgtgggaccctaccacagagatggatcataaaggccctatgttcgagactattagcgtgctgcagttggttgctgcaggcagcctttttctggcgactaggccggttctggctgtaccattttcctgagctttggcaggcttacagccctgacagccaggtgcctgagcctgcctggtgaatgcgcatgtgacagccaggtcaccaggcaccagtggtgagcagtggctcacgtcacagtgaatgccaccgttgcctggtgacaagtcccttcatcttggcagagaaggaatcctctgtggatgtgtgtcagtgttggactctcacctgtctactctgagggctctatgggatattcccacaatccttggagtgggcagtggtgagccagcctgaagaaacatcaagtggagccccaggaataaaccacgaaatccctaaggatccaaaaggatacccatgatgagtcaggcctgcctagacggtgtgggggtgagtctttttgaaacttcctccttgtgatttctaggtacagcccacctctgtttcctggagctgctttctctcagaaggggctttctgcagaaccacgcagcctcaggagctgccaggctgtgtgtttctgtggaattgttgcgagtgttcggatgtctgcatgtgtgtgtggctgtgtgtgagtgtgtttgtgtgtgtctgtgtgtgtgtgtaagtggcatctgctaaaaggaatgtgactaacgcaccgcagcactttcttttttttgagtcccttcaccttctggtgcacctgtctgtgtggctctgcttggcctatggggctgcatgttctttgtttttccatggttcctgagtccacagtgagttgggggggggggatggctgagacccacaggtgtacaaatcacctccccatacaaaggagccactcttctagaaaaaagaggagcacatcactgtcaggaacagacacctgtcagggcctcattttcctttggccaacccagagtgggaccctagcagtcctgtctgcaggccccttgaatccaattcaaattcagtttgcagctgagcaggtgcttcacatcatgaagggagcactcctccaacatcttgggatttcattctagaactaagagtgtgagcagcaataaggtcagataggggtgagcatacaatctgctccttcatctgcaaaaaaaggtgcagacagatgacacaggaagtgcttccaactccatccttgcattcccttcattgcacaagctgtccacaacgtggccctgtggccaggtgggaggactccaacttgcagggaataaaaaataaggtttaactgatacaaaaagtttatctctgtaagatgaatccacacatcacaaatcatttgcaaagatagcttctttctagtttttatgccaggatattaggtttttcactgtagtctacaataggctccgaaaagtcccttcatagattctacaaaaaaggtattttcatcctgttgaattaaaacaaaggtttaactctgtgagataaatccacacttcacaaagcattttcacagatagatagtttttagtttttatcgtgaaatatttggtgttttactttagtcctcaatgttcacaaaaatatcttttctgtgtatgctacctaaagagttttgtcaacctactgaatgataataaaggtttaactttgtgagatgaatccacacatcacaaagtattttcactaatagatcattgctggtgtctatcgtgggatattcagcttttcaatatacttgtcagtgggctccaaaatgtccttttgtagattctttaaaaagagtgtttccaatgtgctgaatcaatataaaggtttacctctgtgagatgaatccacacaccaccaagtgttatcaaatattgcttgtttctagtttttatcttgaaatattcattttttcactatcagcctcagtgagctccaaagtatcccttcataggttgtacaaaaagagtgttgccaacctgctgaatcaaaacaaaagtttaagtttgagttcgtgagacaaatccacacatcagaaagcattttcacagatagcttgctgctagttttaatcactggtattaggtttttcagtatatccctcaatgtactttgaaacgtccctttgtagattctattaaaagaatgttttcagcctgctgaatccaaacaaaggtttaactctgtaagatgaacccacatatggcaaagcatttacacagatagcttgtttctagtttttatcagagaatattcaatttttcatggtaggcctcaatgggctctgaaatattcctttgtagattctacaaaaagagctattccaacctactgaatcaaaaaaaattatctctgatagatgaattcacacatcacaaaatattttcacagatattttgtttctagtttttatcacaggatattaggtttttctctataggcctcagtggtctctgaaatgttcctttatagattctacaaaaagagtgtttccaacctactgattcaaaacaaaagtttaactccatgagacgaatccacatatcgcaaagcattttcacagataacttgtttcaagtttttatgatggggtattttgttttccactgcaggcctcaattgacttcaaaatatccctttgaatgttctcaaaaagagcgtttttgacttgctgtaacaaaacaaaggtttaactttgtgagataaatccacacattggaaagtattttcacagatagcttgtttcctgtttttacagcagaatattcaattttacaaatataggtctctatgggctgcaaaaggccgcttcatagattctacaagagttttcccaacttctgaatcaaaacaattttaactctgtcagttgaatccacacagcacaaaggattttcactgatagatttttctagattttatcaaggaatatttggtttttttattatagttctcaataggccctgaaatatcttttaacacatttcacaattagactgtctgcaacctgctgaataaaaacagaggtttaactctgggagatacatccatacatcaaagcattttcacagatagtttatttccagtttttattgtgagacattcgattttttaaaaaaggcctcaatggtctccaaaatatcccttagtagattctccataaatagtgctttcaaactgctaaaccaaagcaaagctttaaccttgtgatatgaatccactcattgcaaagcattttcacataaaactttttctatttttcatcatgggacatttgcatttttactacaggcctcaatgggctccaaagtgtctcttcataggttctacaaaaaaaggtgtctccaacctgccttccatagattttccagaaacagtgttttcaacccgctgaatcaaaacaaagatttaactctgtgtgatgaatccagacatcagaaagcattttcacagatagcttgtttatagttttaatcacaggatattcactttttcactataagcctaaataagctttgaaatatccctttgaagattctataagaagaatgtttccaacctgctgaattgaaacaatggtttacctgtgggagatgaattcacacatcacaaagaattttcacagatatcttgtttctactttttatcatgggatattcagttttccactgtaggcctcactgggctttgtagtattccttcatagattctacaaaatggatgttcccaacttgctgaatcaaaataggtttatctccgtgagataaatccacacatcacaaagcattttcacagataccttgtatctagtttttatcacaggacatttggtttttccctacaggcctcgatgggccctaagtggtcccttcgtagattctacaaaaaggaatgtttccaacctactgaatcaaaacaaagtttaaccctgtaaaacgaatccacacattgcaaagcattttcacagataccttgtttctagtttttatcagaggacattcaactttttctaacaggcctcaatgggatcaaattgtccaatcatagatcctacaaaaagagtgtttccaaactactgaatcaaaaccaagtttaactctgtgaaatgaatccatacatcgccaagcattttcacagatagcttgtttccagtttcaattgtgggatatttggtttatcgctatagtcctcaaagttctctgaaatgccccttcatagattgaacaaaaaagtgtttccaacttgctgagtcaaaataaagtttaaactctgtgatatgaatccacacatggcaaagcattttaacacatatcttgtttctagtttttattgcatgatatttggtttttctgtatagacctcaataggctttaaaatgtctcttcatagattctacaaaagtgtttctaacctgctaaatgaaaacaaattttaactctgaaatgaatgaacacatcacaaaacattttcacagataggttgtttctagtttttatcatggggtattcgggttttcactataggcctcaatatgattttaaatgtccctttctagatgctacaataagagtgtttccaagctacagaattaaaaaaaaaggtttttctctgagagatgaatccacacattgaatagcattttcacagatcgcttgtttctcatttttatcacaggacattcgctttctcactataggcctcaatgggcttcaaaatatttcttcctagatcctaccaaaagagtgtttccaacctgctgaatcaaaaaaatggtttaacactgagatgagtccacagatcacaaatcatcacagatagcttgtttctattttttattgtggaatatttagtttttcattatgtaactcaattggctttgaaatgttcctttgtagatcctaagaaagtagtgtttctaacctgatgaatcaaaacaaaggtttaactctgtgtgatgaatccacacattacaaaggattttcccaaggagcttgtttctagtttttatcatggaatattatgtttttcactataggcctcaataagctctgaaatgtccttttgtagattctacaaaaagagtgtttccaacatgcagaattcaaacaaagggttaactctgtaaaatgaattcaaacatcacaaaacatttttatggatagcttgtttctagttctaatcacaggatattcaacatttcactataggcctcaatggtctccaaaatgtttcttcatagattttttacaaaaagagagtttccagactgctgtgcaatacaaaggtttaactctgtgagatgaatcctcacattgcaaagcatattcacagatagcttatttctgtttttatcacgggatctttgatttttcagtataggcctcaatgggcttagaaatgtcacattgtagattctacaaaacagtgtttccaacatgctgaatcaaaacaaaggtttaactttgtaaaatgaatgaacacatcacaaagcattttcacaaatagcttgtttctagtttttaattgcaggatatttggttttcctctgtacgcctcaatgggatctgaaatgtctctttgaagatggtaccaaaagagtggttccaacctgctgaaacaaaaaaaaaaggttgaactctgttacatgaatccacaattgcaaagcattttcacatacaacttgtttctagtttttaccatgggatatttggttttccactgtaggcctcaatgggctctgaaatgtcccttcacaggttctacaaaaagagtgtttctaacctgttgataaaaaaaagatttatctctttcagataagtctacacgtcaaaaagcattttcacaggtagcttgtttccagtttttatcatgtgacattttgtttttcactatagacctcaaagggatcagaaatgtctcttttacattccactaaaagagtgtttcaaacctgcagtacaaaaaaaaaggtttaactctgtgaggtaaatccacataatgcaaagcattttcacatataacttgtttctagtttttatcctgggatattctgtttttgtccctaggcctcaatgggctttgaaacatccctttgtggataatgcaaaaagagtgtttccaccttgctgaataaaaaaaaaaaaaagtttaagtctttgagatgaatcaatacatggcaaatctaattcacagatagcttgtttctagtttttttgagggttgttcatttttcactataggcatcaatgggatctgaaatgtcccttcggagattctacaaaaagagtgtttccaagctgctgaattgaaacaaagttttaacttttgaagatagaaccacacatcacaatgcattttcacaaatagctggtttctagtttttatcatgggatattggttttcactacatgccaaaatgggctccaaattgacctctcatagattctacaagcagagagtttccaaactgctgacgcaatacaaaggtttaactttgtaagataaatctacaaattgcaaagcatttttacagatactttgtttctagcttttatcacagtatattctgtttttcactacaggcctcaatttgctctgaaatgtcctgccgtatattctacaataagaatgtttccaacctcctgaataaaaagaaagatttaactctatgagatgaaatcatgcatctcaaagcatttttagagatagcttctttatagtttttattaggattttaggtttttcactatcagcctcaatgggctttgaaatatctcctcatcaattgtacaaaaagagagtttccaacctgctgaatcaaaagaaaggtttaatattgtgaaacaaatccacaaattgcaaagcgtttttacagattacttgtttctagtttttatcacgggatatttggtttttcactataggcctcagggggataagaaatgtcccctcgttgattctgcaaaatgaatgtttccaacctgctaagattccaacctgctgaatcaaaactaacattcaactctgtgagatgaatccacacattgcaaagcattttcgcagatagctagtttctagtttttatcatgggatattcagttttttactacaggcctcattgggtttgaaatgtccccttgcagattctagaaaaatagtgtctcccacctgctaagtcaaaataaaggttaaactctgtgagatgaaaccacacattgccaaacatttttacagatagcttgttctagtttttatcatggcatatgtggtttttcactataggcctcaatgagctcaaaattgtcccttcctttattctacaaaaggaatgtttccaacctgcccagtcaaaacaaggtgtaactctgtgagatgaatctacacattgcaaaacattttcacacatagcttgtttctagtttttatcctgggatatttggtttttagtacaggtctctatgggctccgaaatgtcccttcatagatattacaaaaagagtattttcaaccttctgaactaaaacaagggtttaactctgcaagatgaatccacacatctcaaagcattttcacagataatttgttgtcagtttttatgagggatttttttttataataggcctcaaggactcagaaatttcttattttagattctactaaaacagtgttctcaacctgctgtatacaaacataggtataactctgtgagataaaaccacacatcacaaacattttcacagatagcttgtttctagcttttatcacaagatattcagtttttttcactacaggcctcaatgggctctgaaatgttccttcatagattctacaaaagagtgtttgaaacctgcagaatcaaaataaaagtttaactctgtgagatgaatccacacatcacagagcatttttgctaataatttgtttctagtttctatggtgggatattttgtttatcaatataatcacacatgggcttcaaaatgtcccctcatagagtcttaaaaaagactatttccaatctgctaagtcaaaacatatgtttaactctgagggataacccacatatcacaaagcattttcacagatagattgtttctagtttgtatcgtggaatattgggtttttgactatgggcttcaatggactctaaaccatcctctcttaaattctacaaaaagagtgtttccaacctgctgtatataaacaagagtttaactctgtgagatgaattcagactcaaagcatttttatggatagcttgtttctgtttccattgtgaaatatttcatttttcactataagccttaatgggctccaaaatatcccttcgtaaattctaaaaaaagagtgtttcacaactgcagaatcaaaacaaaggtttaactctgtgagacgaatccacccattccaaagcatttttactaataattcgttgctagtttctataatgggaaattcagcttatcaatgtactcgtccatgggcttcaaaatcgccattcatagactctttaaaaagagtgtttccaatgtgctgaatcaaaacaaatgtttaaatctgagagatgatttgcatattgcaaagcatttcacagatagcttgattctagtttttatcagggaatattcagtttttcaccataagcctcaatggtctttgaaatgtcccttcttagattctactaaaagtgtgtttccaacctgttgaatagaaacaaaaatttaactatatgagatgattctatatgtcacaaagcattttaccacatagcttgtttctagtttttattgtgggatattgtttttcactgctggccccaaagggctctgaaatgtccctttgtatattcctcaaagtgagtgattccaaactgctgaagttaaaaaaaaaaaaagtttgttgtgcttttttttgttgttttttttgagatggagtctctctctgtcacccaggctggagtgcagcagcgtgatctcggctcactgcaagctccacctcctgggtccatgccattctcctgcctcagcctcccgtgtagctgggactataggcgccggccaccaggcctggctaattttttgtatttttagtagagacagggtttcaccgtgttagccaggatagtctcgatcacctgacttcatgatctgcctgccttggcctcccaaagtgctgggactacaggcatgagccactgcacccagcaaaataaggttttactatgtgagatgaatccacacatcacacagcattttcagaagtaaatttttaattgtttttatcatgaaatattcgttttttttactatagactttcataggtatgaaatgtcgtgtgttctagaaaaaaaggattcccaacctgctgaataaacacaagggtttaactttgtgagatcaatccacacattgcaaagaatttttactgatagcttttctctagtttttatcacgggataatcagtttttcagtacaggtctcaatttgctttgaaatgtcctctagtacattgtagaaaaagagtgtttccaacctgctgaatgacaagatagtttaaactgtgtgagataaaattacatattgcaaagcatgttcagacatagcttctttgtagtttttgtgttttttttcccccgtgggacatttggtttttcactgtatgcctcaatgggctctgaaacgccccctcatagattgtacaaaaagattgtattaaacatgcagaatcaaaagaaaggtataactctgtgagataaatccacacatagcagagcattttcacagataggttgtttctagtttttatcatggaatattctgtttttcactacatgccttaacgggcttcaaaatgttgcttcatagattctataaaataagagtttacagcctgctgaatcagaatgaaggtttaactctggaggtgaatctgcacattgtaaagcattttcacagagagctttcttctttcttttttagtgaggaatatttggttattcattgttggcctcaatgggctccaaaatgtcctatcatagattccacaaaattaatgtttctgacctacttaagcaaaaaaaaagtcttaactctgtgacatgaatccacacatcacaaagcattttcacaagtagcttgtttgtagtttttatcacgggatatttggttttacactatagacttcaatgggcttcaaaatgtcttttcttagattttacaaaaaagtgtttcctacctggaatcaaagcaaaagtttatctctgcgaggtgaattgacacattgcaaagtattttcacaaatagcttatttctagtttttatcatgaaaaatttgattttttactattggcttcaatgggccctgaaatgtccctttgtagattctacaaagagagtttttccaacctgctgaatcaaaacaaaagtttaactctatgagatgaatccacacattgcaaagcatttttagagattgctttttcattgttttcatcgcgaaacattcgttttttactgtaggcgtcaattcgtgtgaaatgtcccattgcatattctacaaaaaaagtgtaccaaacttgctgaataaaaacaaaggtttaactttgtgagatgaatccacacattgcaaagcattttcacagatagcttgttactagtttctatcttgcaatatttgttttttaaatataggcctccatgggctccaaaatgtccctttgtagattctacaaactgagtgtttacaacctgctgaaccaaaacaagggttcaactctgtgagatgaatccatatatcacaaagcatttttacagatagtttgttttcagtttttattgggggatattttgtttttcattataggcctcaaaggtctcagaaatatcttcttttagattctactaagagagtgttagcaaactgctgtatataaacataggtttaagtctttgaggtaaatacacacattgcaaacattttcagatatagcttatttctagattttgtcacaagatatttggtttttcactagaggcgtcaatgggttcagaaatgttccctcatagattatacaaaaagtgtgtctccagtctgctgaatcaaaaaaaaaaaaaaggtttagctctgtgagataaatccacacattgcaagctaatgcataatgcagagatagtttttttctagttttatcacaggatattggtttttcactataggcctcaatgggctcagaaacgttcctttgttgattctacaaaaaatgtgtttccaaccaactgaatcaaaacaaaagtttaactctgcaagatcaactcacacatcacaaagcattttcacagatagcttgtttctagtttttatcaagagatactcgatttttttttattgtagacttcagtgtgctctgaaatgtcctttcatagattctacaaaaacagtgttttcaacctgctgaattaaaatgaaagttaaactctgtaagatgaaatcatacatcaaaaagcattttcacaaatagattgtttctggtttttattgtgggatatttggtttttcaatataagcatcaatgggcttcgaaatgttccttcttaaattttacaaagagactgttttcaacttcctgaataaaaacagtggataaatctgtgagatgaatccacacattacaaagcattttcacaggtaattattttttagtttttctcatggaatattgtgtttttcaatataggcttcaatggactctaaaatgtcctctcttaaattttacagaaacagtgtttgcaatgtgctgtatataaacaaaagttttcctctgtgagataaatctacacacacaaagcattttcacagataccttgtttctagttttcatcataaaatatttgatttttcactataggcctcagtgggctccaaaatgtcccttcatagattctacaaaaaaagtatttccatccttctgaatcaaaactaaggttttactctctgtgatgaatttacacattgcaaagcattttcatagatagcttgtttctagtttttattgtgggatatttggttttttattataggcctaaaagggctcagaaatttcttcttttagattctactaaaagagtgtttccaaattgcactataaaaaccaagtttacttctgtgcaataaatcaacatatcacaaagaatattcacagatagcttgtttctagtttttatcacaggatattgtgtttttcactaaagcctcaatgggctttgaaatgtccctctgtagattttataaaaagagtgtttttaacctgctgaatcaaaacaacgtttaactttttgagatgaatccacacattgcaaagcgttttcacagatagattgtttctagtttttattgcaggatattgttttttcactcaggccaatatgggcttcgaattatcccctcgtagattagattatacaaacatcgagtttccaagatgctgaagcaaaacaaaggcttaactttgtaagatgaatctacatattgcaaagcatattttacagatagcttgtttctagtttttattgctggatatttggtttttcactgtaggcttcaatttactctgaaatatcctatcaaatattctacaaaaagagggtttccaacctactgaaccaaaaaaaaaagtttaattctgtgagactaaatcacacatcgcaaagcattttcagagacagctttataaagatttattgcaggatatttggtttgtcgctataagcctcaatgttccttgaaatgtctcttcatcgattgtgcaaaaacagtttccaactttttactgtaggcctcagtgggctcagaaatgactctcaaagattctacaaaaagaatacttctaacctgctgaatcaaaacaaaagtttaactctttggggcaaatccatatatcaggaagccttttcacagatagcttctttcaagattttatcgtgaaatattcgtttttttctatagacctcactgggctcagaattgacccctcttagattctactaaaagagtgtttccaaaatgctgtataaaaataaagttttaactctgtatgatgaatctacacatcacaaagcattttcagatatagctcgcttctagtttttatcacgggatattctgtttttcactataggcctcaaagggctccaaaatgtccctttgtagattctgcaaaatgagggtttttaacctgctgaacataaacagaggtttacctctgtgagataaatccacacatcacaaaacatgttcaaaggtagttttttatctagtttttatcacatgatattcagtttttcactataggcctaatgggctctgaaatttccctttttagattctacagagtgtttacaacctgctgaatcaaaacaaggttttaactatgtgagatgaatccatacatctaaagcgttttcacaaattgtttgtttttatagggggatagtcagttttttactacaggccacaaaaagctcagaaatgtcttcttttagattctaccagaagagtgtttccaacctgctgtatataaatataggtttagctctgtgaaataaatccacacattgcaaacattttcacagatagcttgtttctagtttttatcacgggatatttggtttttcaccataagcctcaataggctcctaaatgtccctttgtagattctacaaaatgtttccaacttgctcgattaaaaaaaaaaaaggtttaactctgtgagatgtatccacacatcaaaaatctttttcacagatagagtatttctagtttttattgtgtgatattctgtttttcattaaaggtctcattgagctccaaaaaatccctatgtagattctacaaaaagagtgtttccagactgctgaatcaaaacaaaggtttaattctaagagatcattccaaacattgcaagacacttttacaaataggttgtttctaggttttatcatgggatatttaattttttaatataggcctcaatgggctccaaaatgtacctttgtagattctacaaaaagagtgttttcaactggctgaatccaaacaaaggtttaacactgtgagagaaatgcacacatcgcaaagtattttaattggtagcttgtttctagctttatttcaggataatcagtttttgactacaggcctcaatgggcttcaaaatgtcccctcttatattctacaaaaagagtgctttaaacctgcttaatcaaagcaaaggtttaattctgtgagatgaatccaaacattgcaaagcattttcacttatatcttatttctagtatttaatgcaggatattttgtttctcactatagacctcaataagctctgaaatgtcccctcatagattctacaaaaagagttctttcaacctgctgaataaaaacaaaggtttaactctgtaaaatgaaatgacacgttgtaaagcattttcacagatagcttggttctaatttttgtcgtgggatattcagtttttcaccacaggccacagtgggctccaaaatatccatttgtagactctacaaaaggaattattttggcctcttgaatcaaaacaaaggtttaactctgacagatgaatccatacattgcaaagaattttcacagacagctttttctagttatcatcacaggacattctgttttttcatacacttcttcatgggctctgaaatgtcccttagtagattctacaaaaagagtgttttcaacatgctgaatcaaaatgaatgcttaactctgtgagttgaatccacacatcacaaagcattctcttatatggctggtttctggtttttatctcgagatataaggtttttaaatgtaggcctcaacgttctctgaaatgtgtcctcttagattctacaaaaacagtgtttccaacctgctgaatcaaaacaaagttttaactccatgagatgaattgacacatcacaaagcattttcacagataacttttctagtttttgtcaagtgatattcggtttttcactagtggcctttgtggtctccaaaatgtcccttcatagagtctacaaaaagaatatttccaactggctgaatgaaaacaaaagttcatacatgtgagatacatccacatattgcaaagcattttcacaaataacttgttcctagtttttatcatgggaaatttggtttttcactatagacctcaataggctccaaaatgtccccttgtagattgcacaaaaagtgttttcaacatgctaaatcaaaacaaaggttttaatctgtgatatgaatccatacatcacaaagcatttccatacatcacaaagcatttccacaatcaaaacaaaggtttaactctgtgagatgaatccacatgctgcaaagtatttttgcagatagcttttttctattttatgtcatgggatatttggcttttcgctgtgctggtccgtgagctccaaaatgtccctttgtagattctacaaaaagagtctttaatctgctcaatcaaaacaaatgtttaactctgagagatgaatacacccatcacatatcattttcaccgatagcttgtttctagttttatcacaggatattcagtttttcactgtaggcctcaattggctacaaaatttcccttcgtagattctacaaaaagtgtgattctggcctgctaaatcaaaacaaaggtttaactctgtgagatgaatcctcacattgcaaagcattttcgcagatagcttgtttctagtttttgtcacacgacatttggtttttcactatatatctcaattttctccaaaatgtcccctcatagagtctataaaaagagtgtttccaattttctgaatcatgataaaggattaactctgtgagatgaatatacacatggcaaagaatttttacagatagattgtttctagtttttttgttgggatatttggattttcactgtaggcctcaatggcctctgaaacgtccccacctagatggtacaaaaggactgcatccaatgtgctgaataaaaataaaggtttatctctatcagaagaatccaaacattaaaaagcattttcacagatagcttgtttctagcttttatcatgggatattcagtttttcactaatggccctaatgggctctgaaatgtcccttcttagatcctccaaagacagtgtttccaacatgcttaatcaaaacaaaggtttaattctttgagatggatccagacatcacaaagcattttcagagatagattttttattgtttttatcacaaaatattcatttttttactataggcatcaatgggtgtgaaatgtccttttgtatattctataaaaaagtgtctttaacctgctaaataaatacaaggtttaattctgtgagataaatccacacattgcaaaacatttaaaaagatagctcgtttttactttttattgcagtatatttggtatttcactatgggcctcaatgggcttcaaaatgttactttgtagattttacaaaaagagagtttccaacctgctgaatcaagacaaaggattaactctgttagatgaattcacacattgcaaagaatttttactgatagcttgtttctggtgtttatcgtgggataatcagttgttcatcaacctgctgaatcacaagaaagtgtaactctgtgagatgaaatcacactttgcaaataattttcagaaacagctactttgtagtttttatcatgggaaattcaaattttcactgttagtctcaatgggctttgaaatgtcattttgtagattgtacaaaaagagtgtatccaatctgctgaatcaaaacaaaggtttaattctgtgagataaatccacacattgcaaagcatattcacagctaggttgcttttagtttttattgtgggatattggggttttcactataggcctcaatgggccctgaaatgtttcttcgtagattctacataaaaagtgttttaaacctgctgaatcagaagaaaggtttaactctgtgagatgaataaacacattgcaaagcatttttacagatagcctgcctccagtttttgccatgggatatttggtttttccatataggctgcaatggactccaaaatattactttgtagactctgcaaactgctgaattaaaacaaaggtttaactctgtgaaattgaatccacacatcacaaagcattttcacagatagtttacttcggtttcttactgtaggcctcagaggtttgaaatgtcttttctttgtttctacgaaaagtgtgtttccaacctgtggaatcatagtaaatgttaaactctgtgaaatgaattccagacattgccaagcattttcacagatagctggattctagtttttattgagggatattcgtttttttactatagacctcaaagggctcagaaatgcccatttgtagattttacaaaaagagtgtttcaaatttcctgaatcaaaacaaaggcttaactctatgagatgaatctacacatctcaaagcattttcacagagagcttgtttctactttttattatatatattatatatatttatacttggtttctcactgtaggcctcaatgggctccaaaatgtttcttcgttgactctacagaaacatggtttccactctgctaaatcagaaaaaaggtttaactctgtgagctaaatccacacatcactaagcattttcacaggtgccttgcttctagtttttattacaggatattttgtttttcaccctaagtctaaatgggctccaaaatgtcccttcttagattctacaaatacattgtttccaacctgctgaatcaaaacaaaggtttaactttgtaaggtgaatccacacatggcaatgcattttcagagttagattttttattgcttctatcatgaaatatttggttcattactataggtgtcaatggctgttaaatgtcccttcatataacctataaaacaagtgttcataattggctgaataaatacaaagttttaactctgtgagatgaaatcatacattgcaaagcattttcagacatagtttctttttagtttttatcgacgaacattcattttttcactataggcctcaatgggctcagaaatgtaccttcacagattgtacaaagtgtatccacttgtggaatcaaagcaaaggtttagttctgtcagataaatcctaacatcacaaagccttttcacagatagtttgcttgtaatttttatcgtcggatattctgtattttactgtaggcctcaatgggctctgaaatgttttctcctagattctacgaaaaaaagtgtttccaactctgtaagatgcatctcacattacaaagcattttcacagaaaacttgcttctagtttttgctgcaaatattcagtttttcactataggcctcaatgggctctgaagtgtccctttgttgattctacaaaaagactgtttatgaagtgctgaattaaaacaaaggtttaaccctgtgaggtgaatccgcacatcacaaagcattttcacaggaagcttgtttgtactttttatcgtgggatatttggtttttcactataggcctcattgggcttcaaaaagtattttattagattctatgaaaaacatgtttccaacctgctaaatggaaacaaaggtttcactctgtgagataaatacacacattgcaaagcattttcacagatagctttttttctagtttttatcatgggataatcgatttttcactataggcctcaatgggctttgaaaaggccctttgtagattctacaattaaagtgttttcaacctgttgaaacaaaacaaaggtttaactctatgagataaatccacacattacaaagcttttcactgattgataggttttttctaggttctatcgtgggatatatagtttttctttttctttttcttttttttttcaggggacggagttttgctcttgttgcccaggctggtgtgcaatggtgctatctctggctcactgcaagctcctcctccccagttcaagccattctcctgcctcagcctcccgagtagctgggattacaggcatgtgccaccacacccggctaattttgtatttttagcagagatggggtttttccacattggtcagggtggtcttgaactcccaacctcaggtgatccgccctcctaggcctcccaaagtgctgggattacaggcatgagccaccatgcatggcgggatatagagtttttcactgaatgcctcaatgggcttcaaaatgtcccttcattgattctacaaaaagagtgtttccaacgtgctaaatcaaaacaaacaaacaaacaaaaaaaactttaactctctgagatgaatccacacatcacaaagcattttcactgatagcttgtttctagtttgtactgggaatatttggtttttcactatagaactcaatgggctccaaaattttcttttgtagattgtaaaaaaggagtgtttccaacttattgaagcaaaagaaagatttcactctgtgagattagcccacatatcgtaaagcattttcacagatagcttgcttctagtttttaccaccagatattctgtttttcactctaggcctccatgggctccaaagtgtccccttgtagattctacagaaagagtgtttccaaactgctgaattgaaacaaatgtttgactgtgtgacataattttacacatcccaaagcattttcatggatagcttgtttgtagtttttattgcaggatattcagtttttcactatagacctcaatgtgttttgaaatgtcccttcttagaatctacaaaaaatgtgcttccaaatagctgaatcaaaacaaggttttaactctgtgagataaatcaacatgcagtaaagccatttgacagatagctttcattaagtttttattgtgggatattctgcttttctctataggcaccaatgggctttgaaacgtcccttcataggttctacaaaaaaaaaagtgtttacaggctgctgaatcaaaacaaagatttagctttgtgtgattaatccagatatcacaaagcatctcactgatagtttgtttctagtttttatcgcaggataatttgttttccactatagtctcaattggcttctgaatcaccctggtagattctagaaaaagagtgcttccaaacagctgaatcacaagaaaggtttaacactgtgaaatgaaaccacaaatcggaaagcattttcagtgatggcttctttgtagtttttatcacgggatattcggtgttacactataggcctcaaagaattttaaatgtcccttcattgattgtacaaaaagagtgtatccatccttctgaatcaaaacaagcgtttaactctgtataacaaatccacacaccctaaagaattttcaccttatcccccagcaaggaaactcttgttctcccagcttctatcggagggctgcatgattcctgtaggatgagaaacaggcagccatgtctggcttttacctggtaatctaggctgtttcctttcatctgcccatcctctctcattgtagagggggtctttcactgggctgttgctgggtgggactgcctctcactggggatcttttgtctgtcacggatttcagagagcaaaagggatttcaggtaggctggctgcgctccaagttgtggatagcgatctcattgagggggttgggttagtttgcactttgcaggagacttttgggtcttctgacaggaatccttgaacatggcttggactccagcacaaatccgcttgttctcccaggcaagcgttgatttttctttgctttcatggtgggtccacagtgcccctcaacagcactcctagacaccattttcaggcttgcaattgccctaaacggcctctgagacaccctctcaacgtcatctgcacccgtgagatgctagttcgaggtttgagaacactgcctcacctcggacttgcctttgtcatggttcctgccttctagagtgccctgctgagaagcaggagcccctgcaaggcccagaatgaagggacgtagtgagctcaagggcccggccatcttccactgacccccgcctctggggtctcaggtatgattccatcacgtggacacccgtcaacaactcaccggactgtattttcattcccatgcgaccggattcttgcacacagcctctttctggaacagagtcagaagagcaatttccagcacccacctcacagtttcgaaacgcctcctcctccagcgggacccgacctcagagacgtgccgaggaggccttattgtcgagacatttagggtcccgcagtgggttgtcgcgggcagcattttcccgagaccaggtgcgctctgcctgcaccattttcctctgcttaggtaggctgacagcactgacaacccggcgcccaagactgcttcacgaatgcgaatgcgtcagtctctaggcaccaggcgccagtggtgagcaatggctcgcgtcacagtggccaccgttgcctggagacaactccctgcggcttggtggaggagacctctgtggacatgcattggtgttggactctcgcctgtgctctctgggggatccacgggatagtcccccgattctaggaactggcagggggaagcaagcctaaagaaacatctagtgaagcttcaggtataaatcgcgtaatttctaaggatccaaaaggaactgcaggatgcgccaagcatgcctagtggtctccttgaggggtctggggtggtttgcagtttgcgggaggcatctgggtcctctagctggaatccttgaacgtggcttggagtcaagcacaagtccgctcgttctcccaggcgggccttgatttttctttgattttatgggggttccacagtgccaatgaacagaacttgtggacacccttttcaggcttgcaattgccccagtgggcctctgagacactctctcaaccttatctgaacccgtgagaggccagttcgaagtgtgagaacactgctccaccttggagttgcctttgtcttggttcctgccttctcagagagccgtgctgagaacaggagtccctgcgaggcccgggatgaagatcttctctctggatccggaagaatcataatatttatcaactctgtaaactctcgggaaagcacttgtgctagcaaggtaacctggcctttgtgaattcatgcactagtctccatttctgggaagagcttcagcaccagcagcacataccactgtgagggcaagtgaaaaagtatcactttgggtagatggatataatcctcccgtaaagcttcatttgcaagaaaaccactatcacccttttccacctgtggaataaagatccttcttacatgtccaagatcacctgtgtttaacatatttatgttggctccccagtcatctccgtcttgttcacaggcagtatttgggattgagattcgagatgtaaaagtaatactagattttgtatccctgtgacccaaagacattgaatgaatatacctcaagccctggctaccttgcaaaaggagagccttcaactctgcttctttaaagtaatttatgattctgcagttttcattcacttcagtatcagctaaatttccaccatgacaatattcatcctgtgtaagcataggaccatcttctgcccagacagagaaatacggaactgcatgaggaagccgtccaggcactgcagtagagcctgtgctcctctcagagttctttgctcactgcagagtcggcttaaggctttcctgatcacctaatgtggtgcatgcacccatgctgcctcttcacacagtaaacacagaaccaaaacctccagagcaactttctgcagctcctgaaactgctgtgcgccttaacctcgctttgctctcagtcactgcagttctctcagcaggccacgtttcatctcccagctcctgagcactggcttccatgtcttcactacaacaatcatccccatacccccaacagaatccggagtgaaagaatccggagtgaaaggatccgaattcacttgaagtctgttgcacatccaattcccatttcctgatttttctgtatcacgaagaagaacggtcccagagtttaacagggctgggatcaattcttccagctctggagagaaaaaccgggagtgcaagtggcgggtggcagaggcgaagcttgcaggagatccactgggacccccgggatccctcagcgcccagcagggccctccccgcccgggcccccacagtcctgcgaagcctccccccagtgcccccagcactcgccagaaccagtagcccaggaagcaggtgccgctggccaccaggagcccaagtaccctccccgcaccagtcacacagagacccgctgccaggccggtcagcgcagggcagggccccagaagctcctcaggctccagctccaggggctgctgggcctggcgggcaaggttccgctcacccccagaaaaggagacggagacccacaaggacctcagcttgtctggtgctggaggcctgggctgtcagaatgcctctccgccttccggcaggcgggagccgcatgcgccccctagtggccgcggccagaagctgtcacatcccatgggcgcaggcgcctcagccccgcaaggggcgggctggaggtgccactcccattcatagaccaggaatcagagccctgggctggaagagtctggtcaaaattcttccaaactgagtggggacagagaccaactcacccccagctgcagtgtatgcagtgtagacagatctggactttagccattcctgagcccccccttgcctcacccgtacatgcccggcccacctttcccttcctcgccaggaccccacatccctccctctgagtcgcttcctctctgaaacaaatagtggtgatagcgagtaacacatcagtaacaagaaactagcaggtgctcagtaaaatggtctaccctggcctcttccacagtcaagtgagcattaacaggaaaatgctcattggaagtggagagtcgccggcagcccctccgcctccctccggcttggccttcccgcagagcaaactggggcccagaaagggtgtgggcgaagaccctgtcacctcccagcagggggcgtgctgcccgcggttttcgggatcctgggcgtggagccatcctcacaggaccctcagaggtggagaggagaaagagcacactcatttgacaggtgcagagactgaggtccgtggggcaggggtgagcggcccagggcagccagacctgtgaacagtagagctaggattccagcaggtccccagccagtcactgggtgagcccctgttgtgtggggatcactgaggtgcaggcattctgataaccaccggcttgaggaactcatggtgctccatcctgaattctggggcgctttctaggatacaatatggtaaaggttgtgtaacatgtgtgaggtccagcatgtgcacgaagcaaacagggatagattggggtggtagtacagggacagaatcacagttgggacccttgagaaggcagttggaatttttctgccagagcaggagaaaccctctgggcacccaggctggcatgtgcaaaggcgtagaggcaagctccccctgacacacggctggaggggaagctctaagtgctgcgcacaggctgttcacactgcatccttctccctggacttgctccccccacagcacctccatccttccagttagctatccaggccaccaccctcaccctctcacacccacatcctgtgggccccacatttgagagacaagaattcagttgcttctcaccctccatgggtgctcatcacctggtctgagtccccatcctctctctccccatacttggtctctgcttccatccttgactcctgacgtctaattgcaactcaatactaggtcagatcatgtcacacttctgctctggtgcaagaattatgtggttccttcagttcagtgtccaccaggatttgatattcccaaggcacatctctcactcctttgttctcattttaccttcacacaggaaaacactttttcttcttgaagtgtgctgttatgtagctactcttggcgatgaaatctctgttattacttttgaaattattttaattgtctttatgccctaaagatatttagctatatattcaatgctagcttgaataataatttttctaagcatgcgttttgactttttaaaatttaagatgacattagatgattttattatgtacatcatgatgttttgaacattccacatatagattgttgaatggttaaatctaactattaacaaatgcattatctaagatcgttatcatttttgttgtgagaacacttatcatccactatcgttgcaattttctagaatgcaatatatcatcagtaactgtagccaccttgctatacaatagaattattgaaatttgtttttttctatccagttttaattatgtgccctctgaccaacatctccccatcctgttcccctctctaaccactccagcctctgctcatcgccattctgctctctacttctatgagaccaactagtttagatccctcatatgaatgagataatgcagtatttttctttctgcacttggattatttcacttaatatactgtcctccaggatcatccatgttgacagtaatgacagcattttattctgttgtatgactaactaaatatcattccattgtatctgtttatgtaatacatacataaatgtatgtatacaagcatatgtagatataccattcttcaaatatattattttgcatttatttttattaaaagtatatttctcccttatctaaatgctgataaaaatatgaggtattttcagtccttcctcttaataaaagccaaagttaaaggtctgtttccctgttttttaataagattctatttcttgctgatttttttgagttccctgcacattctgcatattactgcttaatcgtaagcatggtttggattttttttttcctttctgtataatgtctgtttcctctgtggtttatttgttttctttgccaaaactttttattagtttaattcggtcccatttatttatttttgtttttgttgcatttgcttttggggtatttgtcataaattatttatctaggccaacgtctggaagagtttttactaggcttttcttctagaattgttatggtttcaggtcttagatttaagtctctaatccacctggagttcatgtttggatatggtgagagatacaaacacagtttcattcttctacatctggccacccaattttcccagcaccttttattatgtatgtgtatgtttttgtctaatttgtcaaaggttgttattgtttggctgtatttgttagattctctattctgttacattgttgtatgtgtttatttttataccagcacaatgctgttttggttactgtatccttgtagaataaattgaagtcaaaggaaagacaaaggaaagttgttgtctttcctttattttgaaggagagttttagcaaatataagtgttcttaattagaattttttctttcaatactttgaatatgttatcccctttggccctggcctgaaagaagaatttgagaattgcgctgatagttatgtgatgagtagattttctcttgctgcttttaaaattcactttttctctttgacttttgacaactttattaaaatatgtcttggtgtaaggttcttcatgttcaatctacttaaggactcttgaacttcatgattctggatgtccacctcccacctcaaattcagcaaattctcagtcagtatttctcaaaataagctttctattctttcctctatttcaccttcttgtatccacataacgcatatattgctttatttgatgatgtttcataagtctcatagattttttttactctttatcttttgctatttttttttttgttttttgcacctctgtcaggataatttcaagatagctgtttcccactttgccatttcctcttcatgactgaacctgctgttaaaactctctattaaatttttcagtttagtcattatattcttcagcattaacatttctgtgtttatttttatcgcttctatttattactgtaacttctgattttctttatgtattgctttcctaattttgtttagttgtctatacttgttcccatatagttcactgagcttagtatctaaaataattacttccaatttttaaaagcacattgtcaattcctatttctttggggtctgctattgaagcttttttgctttacttaaattgtgtgatattttcctgattcttcatgattattgtggccttgtgctggtatacatatttttgagaaggtggtcactttttctagtctttacaggttggcttcagcaggaaaagttcttcaccattaagtgtggcctggtgttcttgttcggtcaggtggttgagcctgttgatggatttggctgactggcggtgcttcagggtcagaaatgtctgctggttttaatccctctgatttggtagctttgttgggtgaggccacttgaagcactgtggggcacattgagatttgcatgtaccagtcactgagtgtttcaccccatttctttggtgctagttatcttcatgtggtctaagtattaaaattcttccagcgtttgttttgaggcaaagcagaagtttgtccatcaggcagcactccccagatagacattgaatatccactttgatctacttttctcccactggaaaaataatgggctgagggtatacttctcagcacagtattgttctggatatggaagtggtaaagcaaacaaagtaaaatcattcctcttatcctttttaatgagtctgtctttgcttttgagctctttttgggttttgcaatctcacagtggtatttggagttctcacaaaagcattctttcctgtgggtagttgccaaatagatgtctctttgagggaaacagggctgggaacctactattccaccatcttaccagactccctctacatccaaccacttccatctctcaatctctcagtaatttgtaaaataggaaaatacaaacatgtctagaaatcattactaaaactaacagatgagttgagtgaagccacagtatataagccaaatgtgtaaaaaagtcaatgtgtatttttatagactggcagtgaaaatcaaaccttaccctgaaaaacctgaaggaaataccgaggaaaattaaagaatacctacataaatagagctatcatgttcacatgtcagaatattcaatataattaatatgtaaattttccccaaattaatacgcagcatcaacacaattcagtaaaatttcaacaaagggctttgtaaaatttgataaaccaattcttaaagtactttgaaaatataaataatctaaattagtgaaaacaataatgaaaaacagtcacatttagagacatatctgaaataaatactataaagctacagtattcacaacagtgtgttgttacttgaggaaataattataaataattgtaatgatataggaagctcagattatatatatatacacacacatataaacacacacatatatgtgtgtatatagatgtatatatttacacacatatataattttttattaaggaatgcatgaaggcaattcaaagggaagaatagaaatttacataaatattctcggagaagttgaatacccatatgtaaatatgtgaacattgattaatcaaagtacatctgaaaaattaacttcaaatgaatttgagatgtaagtgtaatagataaaagtatatattttgtatgaataaagcataggagaaatttattgtgaccctgggataggaaatggtttcttagatagcctacacatgcagaaaacataaaataaaatgtataaattgagtcttcatgagacactgttaaaaataaattgacaaccatagcctgagagaaatattgaaatacatatatttaataaatgttggtgttcagatttgtatatacataaatcatacagctccgttaaaagaaggcaaatgacctgacaaacattaatgggcaaggtccattagctgctgatgggtaaacacattgcggcgtgcccatatgatggactatttctcagcaataacaagtaagaaattaatgatatgtacaacttggatgatttcaaaggaattattatgaattaacagaagacactaaagactacataaatgttaaaatcgcaattatgtgaaatttttcaaaaggcaaatacagtagctaaaatataatagttttgtcatgggcatcatgtataaggagagaatttaatgaaaaggaccagattgagcttttcatggtcatgggaatgttctacaacatgtttgtggtagtgattatacagtcacatgcattttgaaatgaaaatgtataaaattttacaaattattcatttataattgatgaattttaaagaatgtaaattgaacctcaataaaattatttcaaattatgctatggaagaatgtgtgggacaattggagcatgctcaaaacatagtgaatgtctgcaatcatttagaaaaactgtattttagtatttatttaagccaaacagatgctctccctgtgactaagcaatgttcctgtaaatatatataccacagaaatgtatccttataatcatggcacctttctttataatggctaaaacagggaatgtatccaaatgtttgtcaacagtagaatgaataaattctaaaatatttggaaagaaagctctcaggacagggcagagtgggataacatattcaaagtattgaaagaaaaaattctaattaagaacacttatatttgctaaaactctccttcaaaataaaggaaagacaaaaacattcctttatctctcctttgacttcaatttatactgcaaggatacagtaacaaaaacagcattttgctggtataaaaataaacacatagttcaatggtacagaatggggaatctagatatatagccaaacaataacaacctttgacaaatcagacaaaaacaaacacatacataataaatggtgctggaaaattgggtggccacatgtagaagaatgaaactcaccatatccaaagattaactcctggtagattagagactaaatctaagacctgagacagtaaaattctagaagagaaacctaataaaaaactcacaataaatcacagaggaaacagacattatatagaatgtgaaataaattccaaactatacttacgattaagcagtaatatgcagactctgcagggaactcaaaaaaatcggcaagaaaaaagaatcattaaaaaatggggaaactgccctttaactttggcttttattaaaaggaaggcctgaaaagacctcaaatttttatcagtatttagataagggagatatattttaatgaaaataaatgcaaaataatatatttgaagaatggtatgtctacatatgcttgtatacatacatgtatgtacatacataaacacatacaatggaatgatacttagtcatacaacagaataaaatgctgtcgttactgtcaacatggatgatcctggaggatatattaagtgaaataagccaggcacagaaagaaaaatgctgcattatttcatgcatatgagggatctaaacaagttggtctcatagaagtagagagcagaatggtggttaccagaggctggagtggttagagaggggaacaggatggggagatgttggtcagaggtcacgtaattaaaattagatagataaagtaaatttcaagaaatctatcgtatagcaaagtggctacagttactggtgatatattgcattctagaaaattgcaacgatagtggatgtgttctcacaatgaaaatgataactatgttaaataatgcctctgttattagctagatttagatttaaccattcaacaatctatatgtggaatgttcaaaacatcatgctgtatgtaataaaaatcatccaatgtcatcttaaattttaagaagtcaaatagcatgcttagaaaaaatattattcaagctagcattgaatatatagctaactatctttcttggtaaggagtattaaaataacttcaaaagtaataacacagagatttcattaccaagagtagctacataagagtacacttcaagaagaaaaagtgtcttcctgtgtaaaggtaaaatgagaacaaaggagtgagagacataccttgggaatatcaaatcctggtggacactgaactgaaggaaccacataattcttgcaccagagcagaagtgtgacatgatctgacctagtattgagttgcaattagacgtcaggagtcaaggatggaagcagagaccaagtatggggagagaggggatggggactcagaccaggtgatgagcagccatggggtgggggggtgagaagcaactgaattcttgtttctcaaatgtggggcccacaggatgtgggtgtgagagggtgaggggggtggtctggatagctaactggaaggatggaggtgctgtggggggagcaagtccagggagaaggatgcagtgtgaacagcctgtgcgcagcacttagagcttcccctccagccgtgtgtcaggggaagcttgcctctatgcctttgcacgtgccagtctgggtgcccagaagacttctcctgccctggcagaaaaactccaactgccttctcaagggtcccaactgtgattctgtccctgtactcccacacctatctatccctctttgcttcgtgcacatgctggacctcacacatgttgcacagcctttactgtattgtgtcccagaaagcgccccagaattcaggatggagcgccatgagttcctcatgctggtggttatcagaatgcctgcacctcagtgatccccacacaacaggggctcaccctttgactggctgggggcctgttggactccttgctctactgttcacaggtctggccgccctaggccgctcacccctccccgacggacctcagtctctgcacctgttaaatgggtgtgctctttctcctccccacgtctgagggtcctatgcggagggcaccaggcccaggatcctgaaaaccgcgggcagtgcgccctctgctgggaggtgacggggtcttcgcccacaccctttccgtgccccagttggtgctgggggaaggcaaagccagagggaggcggaggggcttccggtgactgtccacttcctggaaagtggattcattttcctgttaatgctcaccttgactgtggaagaggccagtgtagaccattttactgagcacctgctagtttcttgttactgaagtgttacccgctataactcctatttgtttaaaagaaataagcgactcagagcgcggggtgtgaatactggagaggaagggaaaggtgggctgggcatgtaccggcgaggcaaggggggagtctcaggagtggctgaagtcctgatctgcctacactgcatacagtgcggctggggttgagttggtctccgtccccgctcagtttgggagaatcttgaccagaccctgccacccgagggctttgattcctggtctatgaatgggggtggcacccccagccctccccttgctggtctgaagcaccccctcccacaggctgtgacagattctgaccgcggccagaagggggcgcgcgaggctgccgctggccgcaacacagagctgcattctggcagcccaggctctagcaccagactggctgaggtctctgcggctcttcgtctccttttcggggggcggagtgagcggaaccttgtacttcaggctcagcagccccaggagctggagcctgaggagctgctggggtcctgcccagcgctgaccggcctggcagcgggtcccagtgcgaccggtgaggggagggtgcttgggctcctggtggccagcggcacctgcttcctgggccactggttctggcgagttctgggggcgcctgggggaggcttcgcgggactgtaggggccccaggcggggagggctgtgctgggcgctgagggatccgggctccctagtggacctcctgcaagcttcggctctgccacctgccacttgcactcccggttttcctctccagaactggaggaattaatcccagctctgttaaactccgggacggttcttcttcgtgatacagaaaagtcaggaaaaggggaattggatgtgcaacagactccaagtgaattcggatcctttcactccggattctgttggggtcatgggggtgattcttgtgatgaagacatggaagccagtgctcaggagctgggagatgaaacgtggcctgctgagagaactgcagtgactgagagcaaagcgaggttaaggcgcacagcagtttcaggagctgcagataattgctctggaggttttggttctgtgtttactgtgtgaagaggcaggatggatgcatgcaccgcattaggtgatcagaaaagccttaggccaattctacagtgagcaaagcgctctgagaggagcacaggctctactgcagtgcctggacgtcttcctcatgcagttccgtgtttctctgcctgggcagaagatggtgctatgcttactcaggatgaatactgtcatagtggaagtttagctatgctgcagtgaaaactgcagaatcatgagttacttcaaagaagcagagttgaagggtctccttttgcaaggtagctggggtttgacctatattcattcaatgtctttggttcacagggatataaaatctagtactgtttttacttctcgagtctcaataccagatgctgcctctgaagaagaggaagatgactggggatccaaccaaattatgttaaacacaggtgatcttggacttgtaacaagcatctctagtccacagtttgaagagggtgataggtgttttcctgcaaatgaagttttacaggagaattatacccatctacccaaagagatgtgttcctgctgctgaacctcttcccagaaatagagaccagtgcatgaattcacacaggccaggttaccctgataccacaagggctttcccaaaagtttacagagttgataaaagttatgattcctccagatccagagagaagaccttcaagcaatggccctggtaagcattcggtactgctgtctgcttctagaaagagagaagaacagtaacaaatagaatcgaagcctggaaagttcaaaaatttgcttttagaaggataactcaaggaagcacagatggcagaggctgcagctgaagcagagcgctctgctggcgggacagccatcgtgtccagcacccagagtaatgggccattcagcctagtggaaggcacatgagctgctccatcaaccttcctgcatactcacctactcatgtcccacctcttctagaaactgtgacaaaagggagctaggttgaaatcactgctggaatcccgtttgtaatgactttcactcttggtgtcagtagttttactgcttgggacttttatttgtgaattacagttgaaagctgcatttttacctatgtcaggctttcatctggccttaccagtctttcctctgtaggatggcagtcactgttggatattacaccatcctgtccagggctagccactgtggtggtgtgctgcttatagcttgctcttgtattgtaataaaagatatctttccctgtcgtgatttgtaagaagaactcaagggcattgttacaaaaatattctcccttcaaaaagagaaaagctaaaagactcattactactcagacttcaatacacctgtgtgtcaatcttatatttctttttttatacaaaactgtaaaatatacttttaggtccaaaagtatacttttagtgctttgtaagcattgcgtgaagcctgatatgataattccatggaagcattgccttgggaatttgctgtctttgctgtaagcttgtagcattaaacaaacattgtagttaataggctttctctttgaaacaattatgtgaaatgtacagctgttcttgaggaactttgaagctagttcattgaaaaatgctcctttcccttcccttgtaatgctatattaatgaagtataataattactggttttgtaattttttttctggtaatgttcttctctgactctttaaaaatgtcccttccctcctcccaagttttatactagactgtggttagtctgattctaaatgttttacttagtttatcctcaatattcatgtatataaattgatcctggtgatcctgtacatggctgtttgcaatgccagaatgatttctgacattccaggtttttcacaaaatatattttatttgtgattagtcacttgactaataatatcagctaaaagatgtcacaaaaaataaaataaaaaaagtggctgggctcagtggttcacacctgtaatcccaggactttgggaggctgagggaggtggatcacgaggtcaggagatgcagaccatcctggctaacacggggaaaccccatctctactataatacaaaaaattagccgggcgtggttgcaggcgcctgtagtcccagctgttcatgaggctgaggcaggagaatggtgtgaacccaggaggcagaacttgcagtgatcggagatcgcgtcactgcactccagcctgggcgacagagcgagactctgtctcaaaaataaaataaaataaaataaaataaaatataaaattaaaaagaatttgtgtcttgtttgtttcctcattaatgttggttgaaagcatatttgcacttgtctttgacttgcattttattaacatagattggcatattaaaagtccctctgagtttaccttaattgtctaaaaaaatgtaagaaaaagggcctgtgggaaggacaaccaggcagaggggctagtgtgagcacatgctgggcaggagggaagagataatgacgcggaccagggaaatccccaaacccagcaagtcagggagccaaatgaaagcctttcatcctgtatcggccacctaaccccatcgacactccaagtgagcattctcttttagagatactcattgccctgttttttttctgtaatcttgtaaaggaatctgatttctcccattagactttcacagtactaaaatttcacattagaatgctattctttagaaggcaccttcctagactaggctgcaaggagactgaggaagttactgtcagtcacttaaaccccacagggacattaattcaacagagctttggtgggggagtagaggagctcactgcaggcaggtctggatgctgcacagagtgtaaagggagcagaaagacccaggacacctaggcctggagatagctccaatcccgggaggtactgttattatccccattttacagaggaggaaactgagacacaggcaggtaatatgatcaagaccacgctgccccacagtagaggagccaggatctaaacccaggcagcctgccttgctatcagagctctcacccataacctcatgctgctgttaagcaggattgccctgtggccagggtcacagcctctgggttcacattctagctgctctaccacttcaaggtgtgtgtccttgggcaagttacttgtctgtgctcagtgtcctctatacagtgggtgtagcagtacctgcctcatggagtcccttaagtgagttaatagctgtaacatgcttagaatggtgtcatgtccatcatcaccatccactacatataggccatcatacctgaatcccagatggacacatatccttgaagggtctaaaatccaggatcctgaaatacctggaagtggtatcctgaaatcctctggcagcattctaacatcttttgactgcagaattgtaccctgcttcccagggctagaaggtgtggggtaacctgctacccagttcagccccaaagtaggaaaagaaagttttgtcacaggcttgtctggggcccagcccctgtaacctcccccatccctcctttgcatgctccctcacccagattcacacatgcactccaggtcttctgggcccaaagggaaggagagagggtggggagtgggttcactggtccactggagcatgctgcctccagccctgctaaactggtgggtccagggaatgggcctggagctgaaggggtcttgatctccctttaactttaagccttcatttgcagtgacccaagagcttcacttcttcctgtgagcctgtctggatgtttatgctggatggcacgggccccttctggcagggctgcaaaggtcagggcctggctggcagccatggcaggtgaggagaccttggcagatgagaagaccttctgcttcagcttcaatgtatgggtcttctcctagctctcagtacattcctcctgagccatgattggccccagttcaatgacaccttctgcggcagcatcatggtgtccaggggtataatctgtagcatgtgccagtgctaccccaaggtatatggtggtggggctgagtggagccagaagggctggatcttgttcctctcttccgtgtatgagccccatccttcaatcatcttcttgttcttttcattttgactccctgttttattctgtcttctcttctgagtatccatccattcatttatccattcatccatctattcatccctccattcatttcagcattaatctatcaatccatgcatccatccatttatttatccaaccacccatccatctatctgtccatcatttagcataaagattgatcataagcctcctggttctggagccatggaccagacaccatggggagacatgatgaaaaagaagatataatttgtgtgcttgaaacaaaagttaatgagtgcttaccacctgcctggcagtcctgcattcagggtgcagttctcccctcatcctgagtttttggtaccttctgtagtttcattttgtagtagagaatgctgagcctcacaatatgtggtcactcagctgcatagtggagtttagattggagctcagatgtgtgtgacttagacatcaccctctgccttgagtcctccactccagggtcccagagctgctgagcattctggggttggtcagctctaaccttggtggcatgcattgagcaactctccatattttggagtcttaatgtattcttagccttagtgatggcaaggaccctgctttgggagacctgggttctagttccagttctgtcccaaacttgctgtgtgatctttgtctttctgagcccagtatttgcatctgcacaataggacacaagcactaattttcatagcctcatagggttgttgcagaggtcagagaagagaagagacatatgaatatttgtagattgtagagtgttttgtttaggtgaagggctgtcagatcctgataaccctctggaatgaagatgtcagaaattgtaaaccttcaatgcccagagaggtggagtgactcttccaaggtcacatagctagtcagagacagacctaggggaaaaaagaagagaaacatggattctaacttgggctctgtctctaactgcctgggatactgctcaagctccttccctctctgggcctcagttaccttgttagtacaatatgtgagacaggatgaggggatggaagatggagggagggacctgctagagctcacctctacggcccaggcttgggaatccccagaacccccatattgtcctttacacctgggtggctgtactcaagggctcagggaggggggactcctgtggccctggactccctagccattccccttctgtgggcccaccctaggctgtcagcgtgttaggtgctggaatggtctgagctggtttgtagtcatttccgaggcagtttatggtcgcctcacctctgtccatgccatgtcctgagcagaggccccagagagaagaagtcctgggggccagagccacccgtgtcaccactagccatggtagtcctcttccccgtgaggagggtgcaccctgggagatggcatcgggtggaacgaagcatctgtcctgacctccctgttaaccagaggtggctctggggctctgggcagggatacaggagtggcagtgggaagcaaagtggaggaggaaatattgctggatactaatgagtcacagttgatagattcatgtcttcatgtgctgtggaggcagtgtggtggggtgcagatggcgtatgttttggtgacctacaggcttacattcaaatagctgttacctcatgttccacatctgtgaccttggcaggggaagctcctcaaccccgaaccttgcatagctgagtgggagaaaccagaagggtcttgtgttgtcggggacctggcatcatgcctggcacagagagtttgcaaaatcttcattctcaagattggcatttgtagctctaggggatacacacagaggtctctgtatgtatgggcagttacatgtggataggtgtgggtcggtttgtgtgtgtgggagtgcatgtttcagggacacaggctattcaaaccagcacaagttgactctaataagggaagggaggaaagcgcatggtaaaccaggaagacgctctagagatgaggcttccggcacccctcatggcctcttggtgcctgtgccattgtagccttcggtgctcatgcatgtcctaccctcagggtcctcccttggacctcagtgcctggcctgtggaaagcttcagtaaatggggaaacataaatataagggaatataactagctaattagggtaattaagtgaggagtagccatttccaacatacattaagctgtccctgatttttaggggctggaggtctagtgagagagacaatttgctgcatgatggggaagaagtaggattcacagagaaggtgagtttggctttgtaggttaagtagaaattcaccaggcagagaagatgtaggaagacacttcaggaagaagagcaacaggatcaaagccatgtggtgaaaggagaaggcaagtgggtcagcaatgctactagagggggaggagaacaagtcaaggtggaaatggaggggccttagctcctcagtgcctggggtgtcatgctaagaaatttggatcttaccctttagttgataggacaagggaggggcatgaccaggtttgcagtttgagaaaattatcaggctgatatctggaaagaggaaggtctggggcagcgagaccaatgggaggcttctctgctcaggtgagagatggtggtcatctggattagggagaatttgaacccaaggctgtagaaactgagaagacagttccagtttaccatatgtggagtacctgctgtggctggcagggcaccagcacttctacccaggttatttcattaaaattctaaagtagacctggtcagctctggaagccacctgggcctcaggcatgagagaggagaaggaattggggcaaatctagtgggtgggtgcagctggagatgctgagcctgttaccaaagatgggacaggaaagtggggagcagggaaaggagtggaagggagagtgaggcctttccctgcctggctgaagcccttacccataagcctcccattcctcattcctgccagatctgctggacccaggaccaggaccctggttggtgttaaaggttctgtctcccctgtgggcctccctccctctgcttcttccttctgaggattgctcagtgttctgcctaaccataaatctgacggcatactctcctgctgataaatcttcaaggatgcctctgattctgggcaaagcctgagcttcttagttttatgttctgggggtctgcattctttgatatcccctccccagcttcaactctgccttttcctcctcatcaaagtacatgtattttaatatgctacctcctctccttttcctccaagattttcataattgtggttgtgatgatgatgatgatggtgaggatggtgatggtgaaggtggtgataatgatagtgatagttaagttgaggatgatggtgaggatggtgaaggtggtgataatgatagtgatagttaagttgaggatgatggtgaggatagtgatggtgataatgatggtgatggtgaggaagatgacggtgaaggtggtgataatgatagtgatagttatgctgaggatgatggtgatgatgatgatgatgctgagaatggtgaaggtgagtatggtgatggtgatgataaggatggtgatggtgaggtgataataatggtgatggtctggatggtgatggtgaaaatggtgacggtgataatgatgatgatggtgatggtgaggatggtgatggtggagttggggatgatagtgataattatggtgaggatgctgctgctgatgctggtgagaatggtgagggtgagactgatgatgataatgaggatggtgatggtgagtatggggatggtgatgatgcaccccttgatttggcaattcgacatctgagaattgttcatttcttctagggttttttttgagtcaagacttccctacgttacccaggcaggccatgaactactggccactagtgatcttcccactttggcctcctgagtagctgtgattacaggcatgaacagtggtgcctggttttatcttaggaatttatcctgaggatataatcagacaagtgtgccaagcggtacttagagaagggtatttattgttgcattgatgatagtaggtaagatgtgggaagaatgtaaatgtccagcaataagagattggccaaataattgtgctacagctaggcaaggggctggcttatggccattcaggacacagaccctcctgattgagtcaaacctcctgtcactgctctcacacacctccctccttttcagcacaaattaccatcataattttacatttctttgtgaacctctttgatgactttctgtatccctcattagttgccaagctccatggaggcaaggagtatactatgctcattattgtgtcttccgtaccaagttaagttcctggaacacagtacactctcaataatttgttgttaaatgaatgactgagtccatatttcttagtatggaaagatgtttgaaatatgcaattaagagaaagagcagattataaaacagcatgcatgctgtagtacacactgcaaattccctcctttcttgatcttctttgggggaccaaatgtgcactctcagtcaataaattatgattgccccttgcctagctgtagcacaaagtcaatcatgacaatgctattctctgatgctagggttggtcatgagatcaggttctggccaatctaaacacagatttccagacctaaagagaaatcctctggtggtcacctcagaagttcttgcttttctaataaaaatgtagaagtgactgcttttgctggccttggaaacacttgtagtggttggagctgcagcaaccatcttacagccatgagctaaattccaatagactcacaaagatgctgggcctaacattgttgaaccagtgcaccatagccagggaccatagatactctaactatgtaagaaaaatgaacctgtatttgtttaggtgactgaactttcagattaacgcactcccaacagatacagagcatgatcccatatatacctgtatgtgcaagtatgaatagaaaaataattaaagtgattatctctgtgtggtaggattctccttcatattttttattttataaagttttcccaaacggcgtgtaaataataatcaaacacatatttctgtacattcagaaaataaacaatggtactaattttattttttaaaaataaacaaaatattggggctccagaaggtagttcactaccatatgataagttaattagccacaaccgagaagaacacttgtgggtttcctggatgacaggttcggcagcagtgagaggtcccctccagaacagtatgtggttccaaactcctgagggcagcggggcagaccccagggaagtagatgagaagctgagtgaggctctgtggggagagaggatgttcctcagccctcacaaggacatgtcagtttcacttgagattaggccctggccttggctgggcagcatgctaggcaggttctcagcagcatggggtgataacaggacgaggggaagcctggcatgctggggcagctctggggtcctcaggtggggctgtctcgggcagcaactctgttggctgtaaacacagatttctaggaggcagagcattgcaatctctcccaccataaacctggaccatcagggacgtttccatagcagcatcaacaccagtgaggaatcgggacgcaatctgtaatcccctatcccacttttccttttctcttagaatgggacagagcagcctcgagcagctagtgtcctgtagtgactccagtttgctgctctcttccttatcttcttcctcctgccctctgcctcctctgcattcttcaccttctacatcaggaagctcaagtcaccaagctaagcctgggcttctcatctaaatcacggagtgccagtcaatgcctcccttcctcttcccagggagcaacttcaatcttccctgcttgcagtgaggagctagaccctactcctttttccctgtgggaccatccacagcctgtttcctcacccctgtaatgggactgcagtcctccctgcccatctggcagtgctaattccaggccaggggccctcctgggaaaatcaccagtgtgggtgatatggtgagtgtttgtgtgtgtggaggggtggggctgccctctgaccatttacagaccctgtccttcctctctccccatgcttgtcgcatgtcaggaatccctctcctttgtgccatgaaatagaaggcattttcagatccatcatctcattgagacttgcatctccttggtgaagttggagttattgtcaccattttactgatgagtaaaatgagtctcagaaaggggaaagtcgttgcccagggttccgctgtggacttatagtggagctgggattaggatgcgtgttctggattcctggcggggtcctggcccatttgcagctaaggcctgtctttctgctcccatgaggtcccttttccattcctttcctccccatgacaaccactgtcaccaccacccagagcctgtgctcactgtcacaccacccttcgctgacccctgcatcttggttggatcccaccatgtccatcagacagattttcctcaatggtggttgggctccaaatctaccctccccagactgacacaaattgcactacagggggccccaactgtaggcgtttctggtctagagagggagatggtcccgtagaaatgtcaacatcacttggtagaggagagtggaagcacaggagaaagttcaggaagtgacatcaggaggaggtggcccttgagttgggtcttgagggatgtgtaagagttaccaggtgaggaatgctgggaagggaattccaggaggaaagagcagcattctccaaggctcagactggtgtggtcactgcagggtagagctaggtgacctggaccccttgagacagtgctccccttttaggaggacatctgcagttcccatactttgggctgtctcagaatcccccagagatcttgggaaattcctgggtccagttcccagggattctggtccaggcagaggaatctgcacttctcacaggcaggggctgtgacctcgccccacagttctgatgcagttggtccccggatcactcttggagaaatacaagcaggactgagaggctttgacccaagcactgtgcagggggtgggatggggatagatgtggaatgggccagaggaatagtggttagatctataccctcctgtatgaccctgtctaaaatatggctctcccatccccctctcccactgacacattctatcctccttcacttttcctttattttattttactttttgtagatacagggtctccctatgttatccagacaggtctcaaattcctgacctcaaccatcctcacatctcggcctcccaaagcactaggattacaggcatgaagcatcatgctctcgtcaccaactcacatgctgaccatttgactagttcagttattacctgttttactctattagcatgagggctacatgaggaaagggactttatgtatgtcattcactgctgtagccaagcatctacaatgtgtgagttcatggaagctttttatgttttggtttgtaattttaattttgggaagcagaagatatctgattggactcagtggctgacaggaaaaggaagaacagtcctggtgtgcacaagagtgacagggagacctagatggagagatgtcagaggacagttcctggaagaggctgacggaaaggtaaggcaactggggagggtctctctggacatcaattcctttgaagctggcagggagggaggaagtgcatgggtggagaggaatgcctgaagaagacctccttggcttccatattcttcatgaagtgacaggtgaggggtttccttggaagagagggtaggaggggaacaagtgtaggctggtgatggtgggccaggagcagtgccccagggtgaaggggtgaatgcattactgaggctggactctggtcatgacccttgccttggcctcaagattcattaaaaaccagactcctccagtgagcttagatcatgccactgcactccagcctggagacagagtgagactccatctcaaaaacaaaaacaaaaaaccagcctccagtcccaatgtgcccagctggaccatgtgctgcttcctggatgtgccaccatcacaactggaacacaaatcctgagtcaccgcctctagaaagcctacctggattgagtgcccatctgagtgggctcctgcagcacctggtctgtccctactatgtgacttgcatctgcctgcctcttatcacaggtgcctgtggttttaccttcctcagtgtgggctgttgaggactgggccaggctgatccatcttaggggctacagcaggtgccagcaatggctgggctttgtcaggcctgggcaataggcaggcctgtttctcatgctaggcactgggtgccctttgtgggcccaactgggcatggccactgcttctgagtgtcccgaagattcctgggagaggcctggttatcttgggctgaccctcactccccagttccttcctccctctgtcccttgccgaaacccttttgcatgtcctcaaaatcctgctccagcaccagcagccccctggttttcagcagcctcagggaactcttccttttgttccttgctgtgagtaagaggcccaatcccctgaggacactgctcccttgctgtcctctgctgcagcccttccctgggcctgagcagggtagatcctccttgcttctcattgcctccctctttcagctcatcatacttctctcccatataaagacattcatgtgccacgaaatgatgtttcggtcaacatagaccacatgtgcaatggtggacccatgaaactataatggagctgaaagacacctactgcttagcccagtgacataacaagtgtaatattatggcagagttactttaaaaatatatttattaaaaaagatttataatactatagaaaaagaaatatatatctcgtagtgtagcctaagcttccagtgtttataaaatctataatagtgcacagtcatgccctatgacttcaccttcactcaccactcactgattcacccagagaagtttccagccctgcacgttgcatcaatcataagtgtcctagaccagtgcaccatgtctaggtaccatactatatttttatatagtgcaatactctgtttttactgtacctttcatgatatgtttagatgtacaagtactgacaattgtgctacaactgccaacagtattcactgcagtaaactgtgcccaggtgtgcagcctgagagcagtaggctgtgccatagagcctaggtgtgcggtaggtacaatattcagatgtgtgtaagcacactctgtgaagtttgcacaaagaaaatttaccaaaggagatggtgacacatgaagggaatcaatattgaagctcttgctctcagattgcacccaggaccacatccctattcactgaagacttagctcccagttcatgggcactttctcctgtggggaggatgccaacatgcacatacagagcccttctcatgctctggctcttggtccctccacctctagagacattgtctgcaccctccctgagtcacccactcctacctgtatattcttgaccatatcactgcagaaactgtagctactccagaccctgaatttaaaacaccatttttttgaccaaccactttcctttttccagctgcctcccaactccaacacacttcaatgactccaaattttcactttgtgtcttactcaccttctttcaaatttcccctcctcccagctgagactatatggtccagcctgtcatccatcctcttaacactctccactctcttgccccactattgattgtactcccagggcaaaaccacactcccctgaaacccagccacacactccctctgctcctgcactcaggtggctgagcacagccagagagaaacacacgtgccttctggtctcaattaatcatcaagcccaaacatccagtggaccatggatgctgtcctaaaaaactcactcatctcctgagtccttaagtctttatttgttattttaataaa

SEQ ID NO: 56 - DNA, 403825 bp, Homo sapiens
tgaaaaacaactgccgtcctcatagtcttcaatttacaaaaaatcatcttgttcttccaaattttcgataagttcttgaaatttcaaatattttccccatagtaacctttgtatctgatcaagaacagtgatatattatatattgacaataatatttttatccatttatttagtatatatatcaggggtatatttctatgggaaaggaatagacaaatactgacttttatgtgtcagaaatgctattgtatttaataattaaaaacatgctttgagacatgcattaaaattattgatttattgataagacaaaaaattcaaagagattagtttctttaattactcacaataagaaggaagaatgtgaatgaaatataaaattctttcctatacactcctctattttattgttagattatttagaaagtaaaaacaagaatatcatgctgtcttcaaagaaattatattttggtcagtggtataaatcatgtaaattaaaatgtattaagtgcagaaatatgtacaaaactgtagatacacttccattttatttatttattaggagacagagtcttgctctgtagcccagactggagtgcagtggtgcgatctcagctcactgcaacctcccaatcctgggttcaagtgattctcctgcctcagcctcctgagtatttggaattgcaagtgtgagccaccatgcctgaataatttttgtatttttggtagggaaggggtttcacctcgttagcctggctggtctcaaactcttagcctcaagtgatctgcctgccttaggcttccaaagtgctgcagttacaggcatgagccactgcacctggcctatagatacactttcagagaaaaaaagagattattttggtatgagatgatgaatcaaaggattctttgtaaaaagtttagaatttgataacagcagacacatatcagatgaaaaaatattttatgtgcaagggatattgtgagttaaatcagtggggtgggaagaatttaacgtgtggcttttaacgtaagaataataaacaatttgtaagtattttatataatccagcatactctgtatgaaatggagaaaactttttctatcaaaatgctgtaagaggaaaaatattagagcaactattttcactaatatgcttaatcacataatattaaaaattttggaagaaagtttccatcctacatttccattaaaactaaaataataaatttcaatgaaaataattcctacttgagttttgcaaaggagaaacttgagtcttattactataattttcatcattttaatatacaattttaatggttttttaaataaactttcttcaccagatactaaatattttatcttacttttttctcatttataaaattcctttggggctgaggaaaaagtgcttttcaaactttacagtattttataaacaacaaaggtagcattttatctgctaccattttacacttcactgctgcacagaagtgaggaggcgaagtcatttggggatctgggcattcactttcttacaagaaggttactttccaatattggacaagtatagagttttccaaagaggcatatttcattcaggttgcacaatcagtgtcaaggtcccagaaggtcattatccttttcaagtcagttggaatgacatctgcctcaagcaacctagaggcacagctgattgttctatagtaagaatataaacacttcctgtaacttatgtcagtataagtctggtggtagaagagatgcatttgggaagaagaagaaatagaaagcaagtttatttactttaaatatacttataatattttaagtttattatttaaaatattacaaatggaaatatatacacatggctattaaaataagtgtggttttaaatttcaaagcctcattgaagagttggatgacagcaaagggaaaacacttaagtccatgttcattgctaggtttctagattttatttcttacaatactgcttatctttgcataaaaaatgaacaaatcaaaaccatatatatacatacatattatgtatatatatatgtgtgtgtgtgtatatatatatatatatatccccagtagagaactcataattcaacctgatacttgttattcttatttttgttgttgctgttataagctctggtccaagcctggacaaaacttttactcccaattcccattagcatgaccatatgctatatttctttcctgctcaacaggaaataatacgcaatgtggtgcttttgcttagaggagctgtggaagatgcaactaaaacaaagaagagagtgtagattcttacaataatccaaattttggctcacattattttccaagctttccttaatgatttaaaagaagatctcattaatcctcttgcaactggaaaatatataatctattccacctcaaaagatcacaagttgaaagggaaccagatcacagaatcaaagctcagccgatagttactccatactataaaatatacaattttattaaaattggagcagattcctgaggcagatattatgattacagtttagtctgttgctgtatgtaaaataagacgtaagaccaagttcggggctttgctacctactgataattgcagagtggctggtgggtacagaacatgagaaagttgtgtggtttttaactatcctatcaccttccttaaaaataatcacttcaagctgggcacggtggctcacgcctgtaatcccagcattttgggaggccgaggtgggtgaatcacttgaggtcaggagttcaagaccagcctgaccaacatggagaaaccccgtctctactaaaaatacaaaaaaaattagccaggcctggtggtgcatgcctgtaatcccagctactctgcaggctgagacaggagaattgcttgaacctgggaggcagaggttgcggtgagccaagatcatgccattgcactccagcctgggcaacaagagcgaaactccatctcaaataaataaataaataatcacttcattcaactcagatgcattaatagatttgctttatattttttaatgacttgcttagaaacattattttcttacataagcccagtaaaagagaataaagctttgatattgatgataaatttagagcatgtacaattgttatttactctcttggtgaatcacaatttccatgatactacaattgacaagttaatttcactattttaatgatcttcatagttcacaaacacacacacacacacacacacttttctttattctttaattacaaagacaagatacttttgctgatcacatttgatacggtttcactgtgtccccacccaaatctcatcttgaaatcccatgtgttgtgggagggacctggtgggaggtaattgaatcatgggggcaagtcttgcctgtgctgtacttatgatagtgaataagtctcatgagatctgatgcttttaaaaagaggagttcccctgcacaagctttctctctttttgcctgctgccatccaggtatgatgtgacttgctcctccttgccttccaccatgattgtgaggcttcaacagcaacgtggaactgtaagtcgagttaaatctctttcttttgtaaattgcccagtcctgggcatgcctctatcagcagcgtgactaataacagtaaattggtcccaagagtgcagcgctgcagaaaagatacccaaaaatgtggaagtgactttgaaactgggtaacaggcaggggttggaacagtttggaaggctcagaagaagatcggaaaatgtggaaagtttggaacctcctagaggcttgctgaatggccttgcccaaaatgctgatagtgatatggacaataaagtccaggccaaggtggtctcagatgaaaatggggaatctgttgggaactggagcaaaggtgacccttgtcatgttttagcaaagagactgttggcattttacccctgccctagagatctgtggaactttgaacttgagagagatgatttatggtatctggtggaagaaatgtctaagcagcaaagcattcaagatgtgacttggatgctgctaaaggcattcagttttataaaggaagcagagcataaaagttcagaaaatttgcagcctgacaatgtgatagaaaataaaatcccactttctgaagagaaactcaagccggctgcataaatttgcataagtgacaaggagctgaatgttaatccccaaaacaatggggaaaatgtctccagggtatgtcagaggtttttacagcagtccctcccatcacagacccaagacctaggagaaaaagtggtcttgttggatgtgcccagagtcccggtgctatgtgcagcctagggacttggtgccctgggtcccagctgctccagccatggctaaaaggggccaatgtagagctcaggccatagcttcagagggtgcaagcccaaagccttggtggcttccatgtggtgtcgagcctgtgagtgcacagaagtcaagaattgaggtttgggatcttccacctggattccagaggatgtttgaaaatgtctggatgcagtggcatccaggcagaagtttgctgcagtggcaaggctctcgtggagaacctctgctagggcagtgtggaagggaaatgtgaggtcagagcccccacacagagtccctactggggcactacttagtggagctgtgagaagagggccaccgtcctccagaccccagaatggtagatccacagagagcttgcaccatgcacagagaaaagctgcagatactcaatgctagcctgtaaaagcagctgggaggcaggctgtaccctgcaaagccacaggggtggagctgtccaagaccatgggaacccacctcttgcatcagcatgacctggatgtgaggcaaggagtcaaaggacatgattttggaaatttaagatttgactgcccttctgcattctggactggcatggggcctgtagcccgtttgttttggctaatttctcccatttgtaatggctatatttacccaatgcctctaccccaactgtatctagaaagtaactaacctgcttttgattttacaggctcataggcggaagggacttgccttgtctcggattacacattggactgtggacttttgagttaacgctgagaagagttaagactttgagggactgttgtgaaggcatgattggttttgaaatgtaagtacatgtgatttgggaggggttggggcagagtgatatggtttggctgtgaccccacccaaatctcatcctgaattgccatgtgttgtgggagggacccggtgggaggtaaatgaatcacgggggcaggactttcctgtgctgttcttgtcatagtgaataattttcacaagatctgatggttttaaaaagaggagttcccctgcacaagctctctccctctttgtccgttgccataaagtacattatatttagaagacaaagaataaatagagaaactatttaggaatatcatgctaaaaagagtgttatgaatttgtcttctgagtttctatgaacatcagtagcaattcatcaaccaatatttaagggccaaatatgaatcaaaatctactggatatttatattcccattacattgattgaagcaatgagtattatttggttgtaatcaaggatataattgtgcaaggtcatgcagactgagagagtaccttatcctgaaagcattatttttaactctcaggaaattatatagttaattagagaaacttgaatatttaacaaaattaggagaaggaaagttttcttgggagggaaagtaaagtgaatatgcaagataagcaggaatcttgtagactatcttgtggcagataccaccattatttctattttagagataaagaaataaaaacataaagtaatatatctaaagatgtgaagctaatcagtaccaaatactagcaagaatgattaaaaagaccctatcaatatcagaaatgtaaaatatcaatttatgtctaaaagcatatctttgtttatgtctaatacatatccaaggcataagaaatagagaaaactaaatacagcaaaatattgtaataaaataatctttatataaaaaatgatacacttacaattcagttggaaatatataaaaaaattcaagctatggaaaactttccattgtggatttatttcaatttttagatatgtatcaagaaataatttataactttagagtcttacttaactgaagcatgatattttaaatttaaaggtaaaatagaaattatgtgaatccagagttaagtagtattatgttaattgcacaatcttactagaattaggaaatgaatgttaatttgaactatggcatatagtcaagcttttaattcgtatttctttcacaattctcattaagaattagagctgatctggctttttacaaatcatcaacattgccaagatggtttggaatagtgcagtgtttcagagcagagaggttcataaggttttattaggtcccatgggagaacatcaacttgttctattctcccccaagaaacaaacaaattcactcagtgaaaaatcctctgtgagtggatctttgcacactgataaggagatggtacaatagttggcattatagaactttgatgatgtggaagaaacacatggaagtcatactttctgggtaaatcaacaaggttagttagacacaaataaacatatttttctctacgagactaattttgtagaatttaaattccacttgtaattatagagaaaaaagtggcaaaatatatactgtctgcatttattcttgaccaagaaaatcctgaaaagtataatactaaaaaatcgaaaaggaaatgctcacgtgatgtaaatattaggaagtttccaactcgggaattgaggtattacagaaagactaggaagcagctacctacatcaaagcagggtgaattaaacagaagaaatgaggtaccattaattaggttaatgaggaaccttcagtggactggttcttatacttctgaggggaaatggtatagatggagttggaaaagccatgggaagctcagaggtttcagctgtagatttgttcttttagtcaagcaagccgaaagaaagtatttaccaacctttggtgaatgccttgaaagctactgtttcgcatatgttgttcaatgttttagttttggcagaacggtcactatggtttgggctggcattggaagtttagagcaatttgtcttaaaatattttcatttgcaaaattcaacaacactgaaagatgctacaaaatgtagcttgaccccagatgcttatcaaaaatgcttattgaatagcattggagcttatataaattattaatttcaattattaagtattaagatctagtaagagtttaatacaaggtgattacatctttccaaatcaaactaagaacttcttaatcatctttgggtaacatttttggataattttttgtaacattttccaataatggctaatagcatgtctgcttcattttcatagtcagatacctgtgattcatgtgaagaattctcatacatttagtcagagttttatcttattttatttgaaaataaataaacatttttttgccctggaattatgtttaatcttggctccaggagttatgtaataaaccattggtataattgaagacttcaacactggtcttcctattccatatatcttagagttactagttccttctcacttttgaagatttttttttttgacggagtcttatgctgttgccaggctggagttcggtggcatgatctttggttactgcaacctccgactccctggttcaagtgattctcctacctcagcctcccgagtagctaggattacacgcacctaccactacacccggctaattttttttgtgtgtgtgtttttagtagagacggggtttcaccatgttggccagaatggtcttgatctcctgacctcgtgatccaccagccttggcctcccaaagtgctgggattacaggcattagccaccacacctggccacttttgatggatttttaaaatttctatatgactttatgtcatctaaattttaactcaaatgcactcgtgttaatttgttaacattttattttttatttttgcggctacataataggtatttatatctgtggcatatgtgagacattttgatataagtatacaatgcgtcaaaatcacatcaggacaaatggaatatccatcacctcaagcattcatccttttttgtgttacaagcagtctgaccatactcttttagttatttaaaaatgtacaatgaattattgttgactgtattcaccgtgttgtgctatcaaattaccacaatcagaataacttctcaacctgtctccatattttacactgatgttgaaaagtcagttccacagaaagcaatatttcaattcaaataataaattacagtcttgttaaatgttatttaaaatattacagtgaagaatatgaagagattacataaaattttccccaggtttaaaataatactcaaatgcctaaatatatcagagctatttctaatgatgtatttcagtttgtatatctttactcacaaatattatttgaaaaataagacaatcttctatttctttatacatatttacatatgtaagccattacctattagctggcaatttttaaaaaaacataataggaatatataccttttaactttatcattcattgatactattgactacaagaataaaaatatataagtaaaaatatagattttatataaccagcgccaaattatatgtgcatttatcaaacttttggaggcttttacatgagaaggctattacaatcactcaaaaaattttagaatataaaaactctctaatttcaaggaatgtaaatcttttaagaggcaggcaagtgaaaagttgaatcaaattagaggaaggtctatatcaaagtaatggataattattgaattttgagaatttcttattaaaaatattacttgaaactgtctctgtctatggcttaattttttgtcttatggtttttgaaaagcatattttatttttttaaatttaaacaatataattaagtacaaattataaaacccttccattggctaaagttatcaatttacttttcattattatgggtacataatagtgtctatattaatggggtacatgtgatgttttgatagtgacatacaatgtgtaattatcaaaacagggtaactgggatattaatcacctcaattatttattatttctttgtgttaggaacattccaagtctactttttcagttattttaaaatatacagcaaacgactattatctacagtcactctattgtgctactgaatacttgatcttattcattctaattgtatttttttgtgcccattaaccatttcccctctatccccttgttctgctacccttctcagccactgaaaaccatctttctactttctatctccatgagtttattttttcagcttccatatatgagtgaagagatataatatttgtctttctgagcctaatttacttcacttaacataatgtttttcagttccattcacgttgttgcaaatgacaggatctcattcatttctatggctgaatagtgctccattatgtatatatactacactcctttgtccattcatctattgatggaaaattaagtcaatttcataccttggctattgtgaatattgctgcaataaacaattgctgcaatattattgctgcaataaacatgaaagtatagatatttctttgatacactgatttactttctttagggtgtacacccattaatggtattgcaggatgatatggtagttctatttttagttttttttaaaaaacctccaagctgttcatagtggtaatactactttacattccgaccaatggtgtatgagattattctattctccaaatccttaccagcattctttattgcctatcttttgcataaaagtcattttaactgggatgagatgatacaacttaaaatgaccatgagaaaaccgtacatattattggaactaaaatcaacaaaattgatcgtagcccgtgttgctgtggatggagaacaaataaaactctcacacatttgggtaaaaaatcaaactttataaccaccttggaaaatagtttggcagcatcttcatacattgaacataatacctgccagctatttcatccttagatattaacccaaaataaatgataatatatgtccatacaaaaacttgtacactgatcttcataactaattttttcctagtagcccaatactggaaataacccaagtgtctatgaataggggaatggtgaaaaaaatgaacatatccatacaatggaagagtattcgtcaataagagaaaaactcttcatacatgcaacaatattgataaatctcaagaattatactaagtaaaaggagtcaagctattacctgcctccaaaaaagacaatattaaatggtttcatgtatgtaacattatagagagcacaaactattccatactgacaaaagtcagggcagtgcttccttggggatgaaaactaggcagcattaggagagtgagactgaaaggaacatgagaaaacatttgaaggtaatggatttgttcactgtgttaatacaatgcatttttacgtataagacctaccaacttccacaatttaaatatgcacagttaattgtaaaaaaagtatgagtaaatagaaaagaagccacaaagtcacttgacactgaataaatttttcaaaaaagttatcgtagaaaagggaaagtcttatatatgctgtaaaagttaaaggacatgccactagactagatgcataacgtgggaaggaggggagagcattctaggcaaaggaagcaaaggaagaataaagcattaatgccaaggagtgttgagaaggaagtgataacactgggatgaaaaactacaacagggtgaagaacagctgtgaacataacattggtagatagatttatcctctaagggatggcaatacggtaaaagatttccaaaaagttcacataaaaaaatgagtgtcagcgttagtgaaacaaaagtcctggcagagagtaagactggagggagaaaacattaagacaaacaagaatatgcaactttaaataagataaatataaatattttattgttataacaccttataccctattgaccttgtgaactttaaaaacatatgtaaaatataaatcaagaatattctgtatggtgagattatagaatcaaatagcaattcaaagaccccaaattccaaaatgtattctaagtagtataatttttttgttagtaagtgtaaaatctatttcaatcatatctaatcagcttgctcattagaaatagcgtatagtgttttcagctagtaaataagtctgtcacgtttcattattattattattaaagtattattagtatctatttctttccctcaaagtcataacagcctattcactagataaaatcagctaatttttccaacattacacttaaaacaagtctttttttctgaattgcttgatggtgacttttgaaaagaactttcatgaggtagacaaaaataaactgcaaaatacacatttataaaacagaattaaaacaatgatacatgaatctggaattagagaaaataatcagcatataaatagaatctgagaagaagtattacccttgaaaataatggctgtatcatttgtaatatatgtaatactcataacattcatcttgtgggttttttttttgcttttaaacaaacagttttggattttgttgtttcattttattataagtgacacatgtttgtacatatttatgagttaaagtatcatgtttcagtaatggatacattgtataatgattaaatcagtgtgattagcttatccttaacattaaacatttaccaattctttgtgatgatagcattcaagatcatttcttctagttatcctgaaacatacaaagcattattgtcagctattttcacctaccgtgtgataaaacactagaagttattcttcctgtctaactgtaactttgtacctaatattcagataggcaagtaactttgtcatatatgtaacctggtctaaatgaacagtaaacagtgatcggtcttggtttattatgttgactaatagagagatcagtggtcataataatcttttttcaaatgtgtttccatttgtaagaaaattttatttataatttgaaagtgctcagctctgcttttctatatcgttttgataccattgtccacagttgtatgcttttgatgcaaatatttcagattatttagaagtcttaggaaggttaaaattactacatattaatacattatctggcatgtttattataaccaaataaaaaagtttattcctcttttaatagaattttaaacacatgtgagttgttcttgtattcttttatgaaaaatgctcatttcaagagaacacattttaagtcatatttttatcaaatatattaattaaaattataatgtcatttcaaactttattcaaacttaattctcaacctctagcctgcttgtcatgatagtctgaaataataatgacataaaatactctgatgggacaaataaattactctcacctttcttggggaatgagaaagacaaaacagaaaaatcagtaaaagatataaaagcagttttctggagtttattggttatagttacttgtcacaagtatctgtgttcatctgagtctgtaattacgtagctgactctctgaaaagggaacacagtgatgaaaagacaaaacttgaaattacacaattaattgcaaactatttctcctaaggctatatatcacgcctaagagagcctgagcttaaaggttatactactaattctcttttcaaatggtacttttattagccattaaatatcactcagtgtgtgattatttttacccttgtcttagaaattgtgaacctgagacactaaaatgggttaatggctctaaatcagacaatatataaaaatctcaactaatttgtttttgtaaactgtttggatcaagttacatgcaaaaaaaaatgagtacaaagcttcagggaaaaacacattaaataaatgtgtgctttacaataggaaaattataaaatatcagcttttgtactcatcttcttttcaacatctgtatcttgagaatgagtgggctacttctgtagtgaggaaaactcccagtagttaatccgttgctagtcatatatatacatatatatgccatcatatgccatcagacacctgaaattttagatatattattgtaatttatagaacatatttatgttagccaatattaaaaaacgaggatatccattggcttgttaaagaataacatccgaacagtactgcaatgaaagttgcccgctagtaggggtgtgtttttctcacttttataaattcagagtttgaatataatatgggccaatacattgatactgcatataaaataattaaaaatggaacatatcatcaggcagtatacaaatctttcgggatacatagtgttgggtgggggcagaagctacataagaacttaggaagtacagtgggtcagggagagatggtacaaaaagagttatcacaaaatttgcatttcatatttggatccaaacacacacacacacatacacacacacacactcttatacaactggatttggtactttttgatactttttatagacttttttaggaatgtgcccttaacccacgcacacaaaagacctcgctcaagttaactcaacttgtcattacaagcagaagaaagcaaagcattgtggtagttcatcttggaaatatctgtaaggtttttatctgatcagttggcttttttttatgtttttaaaacaaaatagaatttggaaaatgcaagctgtatattatatttgtaatgaattttatacttcaaaaatgaaagtgagtgacttcccagtagtaaatatttaaatacttcaacaattctaatacttaaatagtggattgtaaatttattactgaactaaataaattcttcaaaggtattttatttagtctgtaaaacatttgtcagttacctagctttataatttaaggagtttttcttcatctataataaaaagtttagtctctgaaactattatcataattgtatagttatatgtgtttgattttctagaggagcatatactcaccaaaaagtgttttatatcatcaagaagagtaaaggaataataaaattattaccatattgtagagttgctacaaataatatgctatgctgctgtttcaacaaaactgtctacagtttttttaggcaagtaactcatttcttatatatcagattaatgattatgaaaactgtaaatatgtaaagcaggtatgaagcaataaatttttttctacttagtaaactctggaaacatctttatatcaggaaatgtctttactcttagtgatgtttagaatagccaccctttttagtaatgcaaaagggatgaaaatgccttttacctcatgacttatttcatttaggtcaccatttttatacctgtttgatataagttatttaattttttattttaactttataatattgcatggtctcacttacatgtgaaagctaagaaggttaaaatcttgaataaagaatagaatagtggtttccagaggctggaagggttgtggggaggagaagatgaggagacattggttaatgggtaaaaaataaagttagatagaatcaatacaacctagtgttctggcacaatagggtgactatagttaataatagtttattgtatatttcaaaataactaaaagaacgaaatgggaatttttctaataaaaataaattataaatgtgtgaggtgatatatatcccagtgactccaatttgatcacgataatgcattacattgtaagcttgatttttaaacatacatacattttgaagaatcaaataatctacaaaatttatctattacaaaaacaaaacacagtagccaaccctagctctgttttaatgacaaaaacagaaaaaccaaggagcaatgagagtataagcatgacatttagaaatatagggattataaacaaaagtacacagctatcccaaggtacggtgagtggccagctcctcccttcagctaaggcactctcaaaaggctggcagctcagggctgtttgcaggtggccctcccagcactgggagtaacacataatcctgtactgaaggaggatcttgacagtgtcacgtggcttccatccattccctactttggtgctggatcaccttttgttcagaattgcatattatttcctttcttggtatctcctttgttttgttatatgctctactgtagtttcctaaagtccataggagttaagatttctgagaccttgtacatctgaaatctacacttaactttcaaataattgttagcatgggacataatttaagtttggaaatcaaatttgcttcagaagttaaagtcattgcatcattctctctcagcttcagagatgctgttgagaaatccagtgtcaatttaactttttatcattactatattagcttttccgctttgaattcacctaggatattctctttttcccaagtaatcttaaatttcaggcttatttgccccagaatggatctattttcatccattttttgtctctcaatggggccttgcaacttagaaatttaaattatttgttcaatgattgtctactctctattatatctgtgttctttttaagtattacattattaaattaaatttacggtatattaactatatattcaataatatattaaaatatatattaatgttatcaatgcatatatattatgcattacattattatattctatataatatacatcaggggtattttattaatgtatattaaaattatggtatataacgtatctatatatacatatatatgtttatgttatacaatgtatatgtatacatatacatataggtataacatgtatatacatgtgtgcgtgtgtgcatgtatgtgtacatatatgtagttagcataaagtaaaatggagaccagaactggagaacccctgagtagacaaacccattaaggcctcattagtgatattatattaatcttgcttggtttgtaaacataatttaacttgagctatctctcttatatacccatattaaagaaaactaacatttaaggctaaccaatcaaaagccatcaattaattatagttattatgaatgttgcagcaggatagaccaaataaggctttattggtctatttttggattgataataatgttaatatatttgactttaatgactcaaaaattgtcattactttacttccatgttctctgtataaaagccttcccctggcattccttcagcacagccacttttggtttacagcagccttattcatgaatcactggttgctaaaattaagtatagtattattgtgcttttctttacactttaacagacaaattttatatatagttatatataagcatatatcaatatacatatatttatcatgtataatttgtctatattacatacatatatatggtctacaaaagttctggtctggtttgcaattttaagtttcacttttgttcttagagtgtcacaataatatctttcagtctttctactaaatttcaattctctgctcatatatttaatttaaaaaattcttttgttctctgagtatttatgaagtaccataatcttgtttcacagacatgatagcatttcttttatctctgaaatggtaatgaaagtttttgcttttttctgtttctattttatttttagttacctatcttcacagtctctgttttttccaagttgctttctttaagtttgtctgtttaatattagaacattcctttcgtatctgtgatcttgactcatgtttaagatggagtcattaaatcttatttgagaatttgtacacatgcatgctgtttgtggattgcacatgtggtgacctagcaagacaatattactggaaaatacccagagccaatgtatcaggtcatttttgagggaataatcaggtttctgaaaatataaatctttcactctttagctgcccctacttcctatttgtgtggtattcttcctctcaattgtggtagaactgtggccagaagcactgtggtccagatactttttctacctcgatgggtaataaatttcaattttctaagataatgaaagacagcctcttctgattgcctgaagtagaaaatccaactttcaagcaatcttccaattttcaccctttctcctaacctacctcatgttgccaattactgaaccctgcaaatgttccacagtgcacgtcactttgctgctcagctgtccatactgcctctttaggattttacttgttaaggccaattgacagttaccattatgctggtttttctttgcttaaaatacttttgctattatttccccttctaactctcagaagaaacagatgcaaatgtttgtgtttaaaacaatgtcttcaaactggaaattcatatttactaaaattacctgatttagctcttcaaaaatagagagcaatttatttatattattacatattttcagtaactctttaaactcctttataacatgtgtgcgattgaattccagttacctcagcatcatttattgaaaagggagtcctttccccattgcttgtttttgttagcctcgttgaagatcagatggttataggtgtgtggctttatttctgatttttctattctgttccattcgtttgtgtgtctatttttgtagcaacatcaagctattttggttaccgtggctttataatatgatgtaatgtcgagtaatgtgatgcttctggctttgttcttttggcttagcattgttttggttatttgggctcttttctagtgccttatgaattttaaaatcatttttttctaattccgtgtataatgacattggtagtttgataggaatagcaatgcaaattgctttaggcaccgtggccatttttatgatattgattcttccaatcaatgagcatggaatgttttttctatttatttgtgttacctctgatttctttcagcagcgtttcgtagttctccttgtagagatctttcacctccttggttagctgtattcctaggtatttcattttctttgagtccattgtaagtggaattgtgttcttgatttcactcttaactcttagcatagatgttgttggtgtatggaaatgctacttatttttacacatcgattttgtatcctgaaactttacttatattgattatcaattctaggagccttttggtagactctttagcattttgcaatagaatcatgtcattagcaaagagagtttgaattcttcttttcctatttggatatcttttatttcttgctcttgcctgattgctgtgtttagaatttctagtactatattgaataggagtggttagagtggacatccttgtcttattccagttctcaggaggagtgtttccagtttttgcccattctgtatggggttggctgtggatttgccatagatagctcttattattttgagatatgttcctttaatgcctagttttttgagggtatttaatattaagtgtttttgaattttatcaaaagtcctttttatgtcttttgagataatcatgtggtttttatttttatttctataataaatctcatttattaatttttatatattgcaacaacctagcattccaggaataaagctgctggattagctttttaatatgctactggttattttcgtctccctaggtgtgattttaggatgtcaatttcagatctctaactttttcacatgggtgttttccactataaccttccaaattaacatggcttagctgtgtcccaaagattttggtatgttgcatctttgttttcatttgtttcaaatattttttttcatttctgccttaatttaaattttccccaaagtcgttcaggagcaggttgtttaattagcatgtaattatatggttttgaaagagattcttggtataaatttctattttattgcgatgtggtttgggagtgtggttgatataatgggtttcttaaggacgtcttgcaaggctggtctggtggtaatgaattcccttggcatttgcaaatccgaaaaggattttatttccgcttcacttttgaagcttagtttggcaggatctgaaactcttggttggatttttttctttacaaatgctaaatatagattcccaatctcttctgggtggcagagtttctgctgaaaggtctgctgtagtctgatggggttccctttgtaagtgacctaacccttttctgtagctgctttaatatttttttcgttcacactgaccttgatgaatctgatgattatgcgttttggggatggttgtcttttccactgtctcacaggagttctctgaattgcctgaatttgaatgtcaacctctctagcaaggttggggaaatctctttgtagatcaaagaactatatggttaaaaaacacatatgggtgtggtggctcacgcctgtaatcccaggactttgggaggctgaagtgggtggatcacaaggtcaggagtttgagaccagcctggccagcatgctgaaaccccgtctctactaaaaatataaaaaattagccagtcatggtggcatgtgcctgtagtcccacctacttaggaggctgaggcaggagaattgcttgaatccagcaggtggaggttacagtgagctgagattgcaccactgaactctagactggacaacagagcgagactccatcttaaacaaacaaacaaacaaaaccaataaacaaacaaaagtctgtaaaagtagtagaagaaaatacaagtaaatatgtttataagcttgggtaaggaagaattttttttttttttgagacagcgtcttgctctgtctcctaggctgaagtccagtggcttgatcacagctcactgcagccttgaattccttggctcaagctatcatcccacctcagcctcctgcatagctaggactcaggcatgtgccatgctaagctaattttttatttatttttaaaattaattaattttttttttgagacggagtttcgctcttgttgcctagtctggagtgcaatggtgcaatctgggctcactgcaccctctgcctcccgggttcaagcgattcttctgcctcggtcttccgagtagctgagattacaggcatgtgccaccatgcccggctaattttgtatttttagtagagacagggtttctccgtgtcggtcaggctggtctcgaactctcgacctcaggtgatccacctgcctcagcttcccaaagtgctgggattacaggcgtgagccattgcactgctaagctaattttttttttttttttcctgaggcggagtctcgctgtgttgtctgggctggagtgcggtggcaggatctcagctcactgcaagctccgcttcctgggttcacgccattctcctgcctcagcttcccgagtagctgggactacagaagcctgccacaactcggctaatttttttgtatttttagtagagacaggctttcaccatgttggctaggatggtctcaatctcctgacttcgtgatccgcctgcctcggcctcccaaagtgctgggattacaggtataagcaactgcgcccggccctgctaagctaatttttaaaatgtttttgcaaatatgaggtctccctgtattgcccagtttggtctcaaactcctggcctcaagtggccttcctcatgtggcatcccaaagtgctgggattacaggtgtgagccaccacacctagtcccagaaagatattcttgaacaagaaataaatcacagccagatgcggtggctcacacctgtaatcccagcactttgggaggcctgaggctgatggatcacctgaggtcaggaatttaagaccagcctggccaacatggtgaaaacctgtctctactaaaatacaaaaattagcccggcatggtggccacgcctttaatcccagctactcaggaggctgaggcaggagaatggcttgaacccgggaggtggaggttgcaatgagccgagagcatgccattgcactccagcctgggcatcagagccagactccatctcaaaaaaaaaaaaaaagaaaagaaaaaaaacccagaaaacccaaatcagagagccattaagacaaaaaaaaaaaaaagactaataaatttgactccatcaaaaattaaaactcggccaggcgtggtggctcacgcctgtaatcccagcactttgagaggccgaggtgggtggatcatgagttcaggagttggagaacagcctggccaacatagtgaaaccctgtctctaccaaaaatacaaaaaaattagctgggcgtggtggcgggtgcctgtaatcccagctacttgggaggctgaggctggagaatcattggttgaactagggaggcagaggtttcagtgagccaagtcatgccattgcactccagcctgggcaacaagagcgaaactccatctcaaaaaaaaaatgcatatgtttcagctcagcaaccccacttctctattctcaaataatacacatatgtatgtttaaagaggtatgtacaagaatgttcactgtcaacactcttggtaatagcaaaaaaactggaaacaatcatcatttccatgaaaaaaagaatagctaaataaactatgcccacactatgctattctacataacagttaataatgaggatatgtatattgatatgaaaagatcaagatgtagttaaataaaaaaatgcaaccgggtgcagtggctcccacctataattccagcacttagggaggccaaggcaggaggctcacttgaggccaggagtttgagaccagcctgggcaacagagcatgaccccatctctacaaaaaatttttaaaaattagccaggtgtggtggtacatacctgtaggcggtggtaggattgcttgaagtaaggagttcaagattacagtgagctgtgatcacatatctctaaaaaaattttttttttaagatggagtctcgctctgtcgcccaggctgtagtgcaatggtgcaatcacagctcactgcagcctcaacttccctggctcaggtgatcctgccacctcagcctcctgagtaactgggactacaggtgagcaacaacacacccagctaatttatttatttatttatttatttatttatttatttatttatttaatttatttattttttgagaaggagtcttgctgtcacccaggctggattgcaatggcacacaatcttgacttactgcaaccaccacttcccaggttcaagcaattctcttgcctcagcctccttagtagctgggatgaaaagtgtatgccaccatgcctggctaatgtttgtatttttagtagagacggggtttcgccatgttggccaggctggtctcagactcctgacctcaggtgatccacctgccttggcctcccaaagtgccgggattacaggtgtgagctaccgcgcgtggcctgattttttgtatttttagtagagacagggttttgccatgttctcccaaagtactggaattacaggtgtgagccactgtgcttggcccctgtacaattttaaaatttaaaaaaaaattaaaaatacctggagttctggccttgaaaatcccatccttgtgggcgctccttccagtcttgaggagtgaacctggccatcagtgattctgaagaagcaatggccacagagaaccccagcacagcaaactgagaaactgccatttttgttgtattttattatttcctctagagatgggggggggggtctcaacatattgcccaggctggtcttgaactcctggactcaagcaatcctcctgcctcagcctcccatagtgctgtattacaggtgtgagcccccttgcctggcctggccatctatatttcttttgtttgtttgtttttcatttttgagacagagtcccactctgtcttccaggctggagtgcaatggtgtcatctcagcttactgcaacctctgcctcctgggctcaagccattctcctgcctcagcctcccaagtagctgggattacaggtgcccgacaccacgcccagctaatttttgtgtttttagtagagacggggtttcaccatattggccaggctggtcttgaactcctgacctcaggtgatccacccgtcctggcctcccagagtgctgggattacaggtgtaagccaccacactcggcctttttttcccaatgtttttttttttttttttttctcagagacctttgttctgagatctttatttcttctccctgttctttttccttgtctagtctacctcacaaatcatttcatgattaattttcctaaagcaaagggcaaatatttattaagcatttgccattatttgtactcagtatttggtaatggcaggaatgtttgaagaaagttaatatgatagtaatatggagcaatgtgaagttaagaagagagggagatggcaaccaatcaaaagactatatcaggccgggctttattcatcctgttcagaggtggtcacagcttcccaatgcctacaaaataaaggccaaattcctgagcctaatatccaagaccgtccattctatcctcaacatacctttctgatctcttcattacttcttcccattaaaagcctccaattcagccaattttttttttttttttgacatgggggtctcgctgtgtctcccagggtggaatgcatgacaccaccatagctcactgcagtctcaaaactcctgggctcatgtggtcctcagcttcctaagtagctgcaactacaggtgtgcaccaccacatgcagcttcagcctggctttcgcatgtgtgcgtacctctgttcacagttacttctcctgtctccttaaatcttgcttcctttatttattgattgattgaatgatttattgagacggagttttgctcttgttgcccaggctagagtgcagtggcgcaatctcagctcactgcaagctccgcctcctgggttcacgccattctcctgcctcagcctccccaggactacaggtgcctgccaccacacccagctaactttattgtatttttagtagagacggggtttcaccatcttggccatgctggtcttgaacccctgacctcgtgattcacccgcctcggcctcccaaagtgctgggattacaggcttgagcccctgtgcccgacaaggggtgcgtgttttttaaaacatgggagagggaattgtgcttcagaatcaccaccagctgttgcaacatcgggtgccactccatcccgcttctgaggcacgacggagcactttgggaggccgaggcgggtggattacctgaggtcaggagttcgagaccagcctgaccaaaatggtgaaacctggtctctactaaaaacacaaaaaattagccagacgtggtggcgcatgccagtaatgccatccatctacttgggaggctgaggcaggagaatcgcttgaaccccagaggcgaggttgtggtgagccgagatcgtgccattgcactccagcctgggaaacgagcgaaattccgtctcaggaaaaaaaaaattttttttaaaggaaaaaaaacccctctttttctagccggaaataccctctttcaggaaggcgcgcctgtgccgcatacgcacactcagttacttagcaaagtctgggctaaaccacccaaggcggagcccaggaacaacagagccaccgcatcccccaccaatcagcgccgacctcgccttcgcaggcctaaccaatcagtgctggtgctgcaagaaagtttccagagctttcgaggaaggtttctttaactcgaattcatccgcccaataattttcttatattttcctaaagaagagaagtgcatagaggagaagggacataatttgttaggatcctttcttacgctatgggaatttggggctcagttgaaaagcctgaactgcgtctggggatgttgggcgcggcgaactactttcagtggcgcacggagacggtgtctatgtaagaagtgataacgcaacacaccttgcacaaatttgcgctctgccaaaccagagcattcaggcacgactggctttgttgggtgaggttgttgtggtgttcctgtggctggacgtgattcgcagcatcctcgtatccgctaacaggtactggcccacagccgtaaagacctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggttcggttttgttttcagtttacctaacaccgtgcttaggtttgaggcaggttggagttcggtcaggggagtttgaatatccagaacaggtagtggagaaagttgtggacgcttggttagagagcgctctggattctccactgttgacattgaaaccttgagtgacgaattttgtattaagtgacttagcctcataaaaatcaggggaggtttgcggaatgttaccatgtttaaggcattttgaaggagtagttgctaactttgaagcatattagatgtaaaagcaagaaatacaatgatcctgagatgacacgcttatgttttacttttaatctaggtcaaaatgcggatcttcgtgaaaacccttaccggcaagatcatcacccttgaagtggagcccagtgccactatcgaaaatgtcaaagccaaaatccaagataaagaaggcaatccctgtgaccagcagaggctcatctttgcaggcaagcagcgggaagatggccgcagtctttctgactacaacatccagaaagagtcgaccctgcatctggtcctgcgtcggagaggtggtatgcagatcttcgtgaagaccctgaccggcaagaccatcaccctggaagtggagcccagtgacaccatcgaaaatgtgaaggccaagatccaagataaagaaggcatcccccccgaccagcagaggctcatctttgcaggcaagcagctggaagatggccgcagtctttctgactacaacatccagaaagagtcgaccctgcatctggtcctgcgtctgagaggtggtatgcagatcttcgtgaagaccctgaccggcaagaccatcaccctggaagtggagcccagtgacaccatcgaaaatgtgaaggccaagatccaagataaagaaggcatccccccgatcagcagaggctcatctttgcaggcaagcagctggaagatggcggtactctttctgactacaacatccagaaggagtcgaccctgcacctggtcctgcgtctgagaggtggtatgaagatcttcgtgaagaccctgactggaaagaccatcaccctggaggtggagcccagtgacaccatcgaaaatgtgaaagccaagatccaggatgaagaaggcatcccccccgatcagcagaggctcatctttgcaggcaagaagttggaagatggccgcactctttctgactacagcatccagaaagagtcgaccctgcacctggtcctgcgcctgaggggtggctgttaattcttcagtcttgcattagcagtgcccactgatggcattactctgcactatagccatttgccccaacttaggtttagaaattacaagtttcagtaatagctgaacctgttcaaaatgttaataaaggtttcgttgaatggtagcatacttggtgttttgtcatgatattctctagtgatgtgtgggtacacttaaaactggtgaaaatgtctagggagggatttaattttgagattggtaatgtgcccaaagttaagtcacttgactctggtatacacttgggtgggctgaggggtaagagccttctttgctgtaagtcattacaagttaggatcctggactaatggcaaactttctgaagctcgaatttaaagtctgttgggagtccgaggtgggcggatcacgaggtcaagagatcaagaccctcctggccaacatagtgaaatcctctctctactaaaaaaaattagctggatgtgatgtcgcctgcctgtagtcccagctactcaggaggctgaggcaggagaatcagttgaacctgggaggcagaggttgcaatgagctgagatggtgccactgcaccccagcctggtgacagagcaagactccatctcaaaaagttggatatgcaggcttttttaaagatggtcttgctctgtagtccagactggtatacagtggcacaatgacagctcaccgtatcattcttgggctcaagtgactgcagggattttctttacaaatatgcctgcctaggcctaatcaaagattgctggagaaatagttttgattgaggctgcctgaatagtggtaacgtaactgctttcaattctgcaattattgggtgactatgagctgtgtgtttattgctctgtagtgtagtaacaccgaagtgtttaacctgggtggtagtatgggaccgtaatcttgtctgtttgctgtatatgttttaaatgatgagccaagaagcagctaattactgagtatggaagactactggctgaggagaaagatggcttgcaggtacttaatgtttaaaactgtatcctgatctaagacaatcttcctggtcttgatgagttaggtggcaaattaaagtggttcctcacacagttggtttttgtttttgtttttgttttttttgagacagagtctcactcttttgccccaggctggaatgcagtggtgcgatctcagctcactgcaaactccgcctcccaggttgaagcaagtctcctgcctcagccccccacgtagctgggactacaggggcccaccagctaatttttgtattttcagtagagatggggttttaccatattgaccaagctggtctcaaaagtcctggcctcaagtgatccacccaccttggcctcccaaagtgctgggattacaggcatgagccaccactccgggccacgctgttgtttcttaatgtctaacagcttaactttattgtgaaagactgcagcaacaaatgagattttatctgtatttggtaaaaatgcttatccttgtctaagtctggcaacataagcagtttttaggcttctatcccaatggacattaggcagtaatacatgcgcagtgctaatagaaaatatttgagggagtaagggtgtactaaggaagttctcaaatcttcctgcttcactatcttctgtaatacaacttcagtaaatgtgattctcatcttggcacaaaattgggagtagtgtggggagccctgtttaattttttttttcaggtttatagtagggaaataatgttttctggtactaaaactggcgtggtaagtgcatacttagggtaaggactttaaatcactggccagttaatctctagttggtggtttagcatgcaagaagtacccatgggtatattacacaaatgcgggaatagcatatctagaaataagcctttgatattcatagtgtacctgagaatggtttcacacataattttaggtaatctgccttagtcactctggttttacggatctttgcccacagttcctggttcataacttctatagcccttgttatagtcatgttgggtgtgttaggccacaggaaactcacttaacttctgcccttttaccttccctaagacaggactcataatcttcccctacctttctgagtcctgagacccccatttcagagagggttctgtcctgtaccctggggaaaggaatgctgtcatcgtgaagcctccttagaaaaccaagaggactgagtttggatatctgaacacatggaggttcctggaggatggcacacccaagtaaggcattaaagctttgcaccccttcccccataccttgtcctatgcatctcttcatctgagtcctttgtaatatctttataataaaccagtaaacgtggccaggcgtggtggcttatgcctataatcccagcactttgggaggtggaggtgggtggatcacttgaggctagagcttgaggccagactgggcaatgggctctttacaaaaaaaaaaaaattaaaatgggcatggtggcatatacctgtagtcctagctacttgggaagctgaggtggaaggattgcttgagtccaggagttccaggccagcctagcacagcaagatcttgtcactaaaaacctagctcttcaaacctggaaaattaaaacgtttcactgaatacctaaaaactattatctggggcaatagggcttaaaatattgtgctgtcatttctcccaaagtgtcactgtctgacaatataggctcataggtctgtagtctggtgaatccttcagaagaagattcagctgttgctctttagttctcttttggaatattttattttccatagagatccccctctaagtaattcatggatctcagcaaattcactctgcacacaaatgaatctgagcaattttgagacagagtcttgctctgtagcctaagccagactgcagtggcacaatcttggctcactgcaacctctgcctcccaggttcaagcgattcttgggcctcagcctcctgagtagctgggattacaagagtggtcaccacacccagctaatttttgtatttttagtagagacggagtttcaccatgttggccaggctagtcttgaactcctgacttcaggcgatctgcccgccttggcctcccgaagtgctgggatcacaggcgtgagccactgcacctggccagggaaaggctctttaaatatgtgttggaggcctggtctatggcctgatgccagtccaaaatagttcttgtcagctctcagttaaataaaaatgagaacagcggccaggtgcaaaggctcacgcctgtaatcccagcactttgggaggacggggtggggggcggggtgcggatcatgaggccaggagttcgagaccagcctgaccaacatggcgaaaccccgtctctactaaaaatacaaaaaattagctgggtgtggtgtcacgcacctgtaatcccagctacccaggagggtgaggcaggagaattgcttgaacccaggaggcggagattgcagtgagctgatatggcgccactgcactccagccttggcaacagagtgagacttcatctcaaaaaaaaaaaaaaaaaaaaagaacagctcagtggattttacataaaaaatgtattcaacttaaaagacatgtcctctgtaaaaatgttgtggtctaatggtttagtgtgactctggatacaagacttcttgagtcaaatctggctgcttactagcttgtaacgttgggcaactaatcctgtcagtacatcaaattcctcatctataaaaattgggttaattacacctgtctcagactagttataattacctgtgaagcacttaaaacaatgtaaaaacttggccaggtgaggtggctcatgcctgaagtcgcaactacttgggaaacaagcagaatggcttgagcccaggaattcagggctgcagtgagttaccaggtaatgccactgcactgcactccagcctgggcaacagaatgaaaccctgtctctaaaaacaaaacaaaaccaaaaaccccacacacttgcgtagtgcttaatatgctattttttgtaataaaattaccaatcaagatgagatgataggctgggtgctgtggctcacacctgtgtaatctcagcactttaggagcccaaggtgggaggatcgcttgaacctggtagtttgagatcagcctgggcaacatagtaagaactcatctctacaaaaaatgaaataaaaggcgggaggatcactgcaatgaggttaacgctgcaatgagctgtgatcttgccactgcactccagcctaggtgatgggagtgagaacctatctcaaaaaaaaaaaaaagatgataatgcaataagtaaactgaatgaaggtgataggaacttcgtggggcaatatccaatagaggaaaaaatgctataggaaaaaatatgcctaagcacaaagacaggtgggccactgttaacaatggttgcttcaggagaatagaggagtagttttaaagggaggtatatttcagctcctctctagatattcttaaatctggcacccacataacatcagcattgtccacaagcactccatgtttaagagccagcaatataacagccctgaagtcagactgtgtttctggatagagtagacattttgcacaaatctctggttcaatctctatcactcctatagggcctctagaaactttatctcatgagacttcctgaaccgcgacacacttcattttagctacactttattcattcttcaaagaatctgagcaggcaagccatgactctattttaatcaggcccagctaactctaaatggaagctttagatacatgttgggttctgggaaaggatcttgtacttagcgcagcaataattatttagtatatgagcacttagtttccttagtctgacaataagtacttagtttcctcagtgcaacaaggaagtaggttttgaggtttttccttttttcatacttttttcttatcttttttttttttttttttttttttttgaggcagagcctctctctgtcacccaggctggagtgcagtggcatgatctcggttcactgcaacctccacctcatggattcaagctattttcctgcctcagcctcccaagtagctgagttttatactttcttaatctcccacttttttttttttttttgagacggagtcttgctcttgtcgcccaggctggagtgcagtggtgcgatctcagctcactgtaacttccgcctcccaggttcaagtgattctcctgtctcagcctcctatgtagctgggattaccggtgcccacagccacgcccagctaatttctgtatttttagtagaaacagggtttcatcatgttggtcaggctggtgtcgaactcctgacctccgctgatttgccaacctcggcctcccaaagtgttgggattacaagcgtgagccaccgcgcccagctgatctcccacttttttttttcttttttcttttttgagaaagagtttcactcttgttgcccaggctggagtgcaatggcacgatcttgccttactgcaacctccacctcccaggttcaagtgattctcctgtctcagcctcctgagtagctgggattacaggcaggcaccaccatgcccagctaattttgtatttttagcagagacagggtttcaccatgttggtcaggctggtctcaaactcctgacctcaggtgatccgcccgcctcagcctcccaaagtgctgggattataggcatgagccaccgtgcctggcctcccactttttttaatcatcaaatgttgggtggtgaagttcactctccgccagtaggtcccagacagctcctataaaattctaaaacctattctaaccacacaacactaaccagggccccttttaagaaacactattatcttcagaaatttctgatatcagtgtttccccaaactatcttccaaacattacaaccagtacgaaaaacgatgctgtgatcacaaggagttatccattatctccctcctgaagacctacaatgtcctacaattgtacattagcatatttaagtctctaaggagttctaccttataggaactggtttaacattgtttaacccagtgttttccaattttcaatttcacttatgtttcactttttttttttttttttgaaatggcattttgctcttgttacccaggctggagtccagtggtgccatcttggcttacggcaacctccacctcccaggttcaacagtgattctcctgcttcagcctcccaagtaactgggattacaggcatgagccaccacgcctagctaattttgtatttttagtagagatggggtttctccttgttggtcaggctggtcttgaactcccgatctaaggtgatccacccacctcagcctcccaaagtgctgggattacaggcgtgagccactgcacccggcctcacctttttttggtgggggagacaaagtcttggtctgtcacccaaattgaagtacagtggtgtgatctcgcctcactgcaacctctgcctcccaggttcaagagattctcctgcgtcaccctcctgagtagctgggattacaggcatgtgtcactatgcctggctaatttttgtatttttagtagagacagggtttcaccagtttggccaggctggtcttgaattcctggcctcgaatgatccacccactttgacctctcgaaatgttgggattacaggtgtgagccattgcgtctggcaatcatttttttttctttgtccccaaggccggagtgcagtggcgtgttctcagctcaccgcaacctccacctcccaggttcatgtgattctaacaggaggtgacatattattattaatgaatgataatagttaactcttatttacgcttaccatgcaataggcattattctaaggttttacatgaactggcttatttgattttcacaactatccacccacttaggcacacagagctggggtttgagcccagacaggctggctccagagttcttgctcttaatgcttcgagataagatctcctgagagaataagcagaagtcagtcacataaggatctggaaaacaacattccagaaaatggactaagcaaggctcaagtttctgaggctagccagcactgagatatttagagatccacctacctcagcctcccaggtagctgggactacaggtgtgcaccaccacgcccagttaatttttgtatttttagtagagatagggtttcaccatgttggctaggatggtctcaatctcttgaccttgtgatctgcccaccttgcctcccaaagtgctgggattacaggtgtgagccactgcacctggccatcactttctttttcaatgacataacatttctcataatttgagaaacagtgttcaagccatgccctgtctcctgtctccgtatctagtactgctgattgtgcttggttctaggcgtctttcgatgatagaaacatgctgctgtgaattcgaggcaggctgcacactgggcttggatcttctacttttaaaatagaacaatacaggctgggtgtggtggttcacgcctgtaatcccagcactttgggaggatgaggtaggtggatcatctgaggtcaggagttcactatcagcctggccaacatggtgaaaccccgtctgtactaaaaatacaaaaattagctgggcatggcactgggcacctgtaatcccagctactcaggaggctgaggcaggggaatcactggaactcgggtggcagtgagatcccgccactgcactccagcctgggtgacagagtgagactctgtctcaaaagaaaggaaaagaaaagaaaaaagcatgaaaaaaggaaaagcaagactccgtctcaaaaaaactagaacaattcaaatattgagggggacgaagacttggtctgttgcccaagctgaagtacagtggttcaatctcggctcactgcaacctccacctgccaggttctgaggcggaaaatgaacgaaaaataaaatttagaagaaagagaaataagttttcctatattaggctgacttgtgcagcaacgggcacagcccagacccaggaaaagtcttgataatattatctaatgtgctctggagattctcccagcactccctcaacattgggagaagaaaaacaaattttcctttgttttatggaatgagtttatagattcttgttctctgtaactaatgacttcaagtattctgttttatctaagaagtacaacgaaggtcacaagaagcctgagtaggcctgaactacagctgcctgagcaccatagtgaaggttataggataagcctgtgccctgacaaacctagataacagacatctgggttgcttggcaacagtcatgtgcaatcctgtctttgtcctgcctctgtatccctgatttcatgccactgtaaccttgcttcaagctagcccacccccttttctgaagtgtgtataaaagtcaggtgctgtctttattccgggcccagtcttttacacgtgagtcagccgggcctgagtgcactcaatattctcctgtttcaacccgaggtctctctcgtcctcctgaatcccgcaacagttcaagcaattctcctgcctcagccttctgagtggctgggaccagaattgtgtgtgccataggtgtgtgccactatgctcagctaatttttgtatttttagtagagacagggtttcaccatgttagtcaggctggtcttgaactcctgacctcaggtgatccatctaccttggcctcccaaagtgctgggattacaggtgtgaggcactgcacccggccaattttttgtatttttagtagagatggggtttcactgtgttagccaggatggtctcaatatcctgacctcatgatctgcctgccttggcatcccaaagtgctgggattacaggcgtgagccatcatgcccggtttatagattatcttaatcagttgctactttgctgcagcttgtctttaagcatatgttaccagaaaaattaacagacaaatttcgacatggaatttttttttttttttgagacagagtcccactctgtcgcccaggatagagtgtagtggcatgatctcagctcattgccacctctgcctcccaagttcaacggattttcctgcttcagcctcctgaatagctgggatacaggcgcacaccaccacacccggctaatttttgtatttttagtagagatggggtttcaccatgttggccaggatggcctcgatctcaaggtgggtgatccacccaccttggcctcccaaagtgctgggattacaggcatgagccaccatgcctggcacacacctggctaatttttgtattttttagtgtagacggggtttcaccatattggccaggctggtcttgaactgttgacctcgtgatccgcccacctcggcctcccaaagtgctgggattacaggagtgaaccaccgtaccaggcctggacatggaattttaaaaaattatctaattcgttgctttcttctgagagagagtctcactctatcgcccaggctggagtgcaatggtgcaatcttggctcattgcaacctctgccctttttttgaggcagagtctcactctttgcccaggctgtagtgcagtggcatgatctcggctcactgcaacctctgcttccaagggtcaagtaattctcatgccttagcctctggagtagctgggattacaggtgtgcaccgccacacccacctaattttttttttttttttttgagatagagtctcactctgtcgcccaggctggagtgtggtggcatgatctcagctcactgtaacctccacctcctgggttcagtgattctcttacctcaccctcccaagtagctgggattacaggcgcacaacaccatgcccagctaattttttgtacttttagtagagatggggtttcaccatgatgcccaagctggtttcaagctcctgacctcaagcaatccacctgcctcagcctctcaaagtgctaggattacaggcatgagccaccgcaccctgcctaatttttgtatttttagttgagacagggtttcaccatgtttggtcaggctggtctcaaactcctgacctcaggtgattagcacctctcttacaggcctgagccaccctgcccggccctagtttagttttgttttttcaaaacagggtctcactctgttgcccaggttggagtgcactggcctaatctccgctcattgcaaactctacctcccgggttcaagcgactcttctgccttagcttcccaagtagctgggattattggtgcccccagccatgctctgcttttcatattttttagtagagatgggttttcaccatgttggccaggctggtctcaaactcttgacctcaagtgttctgccccccgaagtgctgcatttacaggcatgagccacggtgaccagcctgattggttttgtaaaatacaaaagtgatacaagctcttgataaaaatacattcagtggcatataagagtatccagtaggctgggtgcgtggctcacacctgtaatcccagcactttgggagtccaaggcgggcagatcacttgaggtcaggaattcaagaccagcctggccaacatggtgaaacactgtctctactgaaaatacaaaaattagccaggcgtggtggtgcacgcccatagtcccagctactagggagactgaggtaggagaatagcttgaacctgggaagcggaggttgcagtgagccaagatctcgccattgcattccagcctggctgtcgcaaaaaaaaaaaaaaaaaaaaaagtatccagtaaaaactcccctctcacctttccttgtatccccagaagaaaccgtttaatgagagtatatgttttcatttatttattcattcaacaaatattaggtgtttgctgttttttaaaaaaatgtaatttaagtttttagagtcagggtctcactctgtggccctgcctggagtgcagtgacacaatcatagcttactacagccttaaactcccgggctgaagcgatcctcacaccttagccacccgagtagctaggactacaggcacctgccaccacaccaggctaattaaaaaacttcttcttcttcttttttttttttttgagatggagtcttgctctgccgtccaggctggagtgcagtggcgccgtctcggctcactgcaacctccgcctccctgcctcagccttcggagtagctgggattacagacgtccgccatcatgcccggctaattttgtgtatttttagtagagacggggtgtcgccaccttggccaggctggtcttgaactcctgacctcaggtgatccacccatctcggcctcccaaagtgctgagattacaggagtgagccacggcgctgggcttttttttttttttctttttagacggagtcttgctctgttgcccaggctggagtgccttggtgctatctcagctcactgcaaactccgcctcccaggttcatgccattctccggcctcagcctcccaagtagctgggactacaggcgcccaccaccacgcccggctaatttttttgtatttttagtagagacgggggtttcaccgtgttagccaggatggtctcgatcttctgacttcgtgatccgcccgcctcagcctcccaaagtagtgggattacaggcgtgagccacagagcccagccgacgcctttttttttctttcttttaaagagatggagtctcaccgagcactgtggctcacgtctgtaatccccaggactttgggaggccgaggcgaggggatcgcttgagcccaggagtcgagaccagcctggacgacatagcgagacttcgtttctgaaaaaaatgcaagcattttgaacccgggaggcggaggttgcagtgagccgagatcgtgccgctgcactccagcctgggcgacagagcgagactccgtctcaaaaaacaaaacaaacaaacaaacaaaaaaacaagcaaacaaacaaaaaaaaaaaccaagcatttggcaggcatggtagcgcacgcctgtggtcccagccagccactctggaggctgaggtgggaggatcgcttgagccagggagttcgaggctgcagtgagcggtgatcgtgccactgcactccagcctggaggacagaggcagaacttgtctcaaaaaaaacaaaaaacaaaaaaccggccagtgtgtgaggggcgcgcgatttttaagatgtgagagagggaattgtgcgtcaccatcaccaccaggtgtcgcgacatcgggtgccgcgccgtcccgcttctgaggcgcggtggcctgagaaactggcttcagagcccgctcttcctagccttctgcccgaaaatgcagaatttggggaattggaactttggaggcgggagcgaaagacctctccttctctcgccggaaatatccctctttcgggaagcgctcccctgccttccggaaaggaagagccctgatcgcgcccctgcactcaagcctctgggtgatagagcgaggagaccctgtctccaaaacacaaacaaacaaaaggtaatggggggggggggggcaggcgcggtggctcacgcctataatcccagcactttaggaggccgaggcgggtggatcacctgaggtcaggcgttccagaccagcttggccaacatggtgaaacccccgtctctgctaaaaataccaaaaaaatagctgggggtggtggcaggcacctgtaatcccagctactcaggaggctgaggcaggagaatcacttgaacccgggaggcggaggttgcagtgggctatcacaccgttgcactccagcctgggcgacaagaatgaaactctgtctcaaaaaaaaaaaaaaaggtagtaggaacattgctggtaattgctgtgtgagcacactaataccacatttatacctgtctttctgaacttctatgacaatgtaaacatgcatatgtatatagatatctccatatatagttactctcaccttgttcacagctgctcttacactagatatacaattttctccttcaaataatgttaatgctaactatgaatgtaatatatgctcagtgtatgaaatttaggaaatatagaaaaagaaagcactcattatccctacgatccaagtatattcagtttggcatgtttcctcttttcccagtattaattttttacttaaataacaatgaatacaatacaagttgtaaggacttgaccagcagatatacagagagtgagtaaaaacattgaagtcctttttcagcgtcccttcccagatgtcctcttcccacacatctttttctgtgccacttgctagaagtttggtgtatttacgaccagattgttttcaatgtgtcacatatgtttgtgttatataaaaacatactttaaaaatcatatataaatgcaattatgcattacacacccatctttcttggagacatttccatgctaacacatatagatgtgccttattcttctcaaactgctgcaaaatatttcatggtatagatacaccatattttacccttctccttactgatggtatttatattgtttctaatttttactattaaaacaatactgcaattaatatctttgtaaatgtctcttgtcacaaatgtgcaagtatttcttcaggatatactagaagtagaattgctgtatcaaagattatggcatttaaaaattggggattattacagaattacccatcaacagactgtacaacaatggaatattattcagccttaaaaggaagaaaattcggctgggcacggtggctcaggcctgtaatcccagcactttgggaggccgaggcggacggatcacgagatcaacagatggagaccatcctggctaacatggtgaaatcccgtctctactaaaaatagaaaaaatagctgggcgtggtggtgcacacctgtagttccactcagctacactggaggctgaggcaggagaatcgcttgaacccaggaagcggaggttgcagtgagccgagatcagggcactgcactccagcctggagacagagtgagactctgtctcaaaaaaaaaaaaaaattctgctgggcacagtggctcatgccagtaatcccaacactttgggaggccaaggtgggaggatcactcgaggcccggagttccagaccagcctggccaatatggtgaaaccctgtctctactaaaaatgcaaaaattagctgggtgtggtggcgcatgcctgtaatcccagttactcgggaggctgaggtaggagaatcacttgaacccgagaggtggaagttgcagtgagccaagattgagccactagtggcactctagcttgggcgacagagtgagactccatctcaaaaaaaaaaaaaaaaaaagagaccagccttgctaacatggtgaaacgcatctctactacaaatacaaaaattagctgggcgttgtagcaggtgcctgtaatcccagctactctagaagctgaggcaggagaatctcttgaacccgggaggcggaggttgcagtgagccgagatcgtgccattgcactccagcctgagcaacaaaatcgaacctctgtctcaaaaaaaaaaaaaatggaacttctgacacatattaccacatggatgaatcttaaagacattacactaaatgaaacaagacagacacaaaaggacatatactgtgtgattccactatatgaggtagctagagtagtcaaactcatagagacataaagtagaatggtgggtgccaggggctgggaaaggagggaatggggagttagtgtttaatggggacagagtttcagttttgcaagatgaaaaaagttctggagatggatggtggtgatggtcacacacaatgaatattaatgctacgaaactgtacacttaaaaatggcttaaacggtacattttttggtatttatagttgatcacaatttttaaaaagactgtaccaatatcaattcccaccagtattgcataagagagagtatctagtcctccaccacttcattaatattatacattatgaataatttcaactttgaacatattgaggggcaaaaacaacacttgattgttttaatttgcatgtgcccaattacttctgagattggataccttttgaatgtttacttaacattaatttgtcttgcaaattatctgttcatttcctttgcccaattttagtatgaatttgttcgactatatattctaacaactaataatttatttaattgtggtaaatattgtctttcagacttgcttcactttttttttttttttttttgagacagtgtctcactctgttgtccaggctggagtgcagtggtgtgatctcagctcactgcagccttcacctcctgggttcaagactcccaagtagctgagcttacaggcacacgccaccacacccggctaatttttgtatttttagtagagacaggatttcaccatgttggtcaggctggtctcgaactcctggcctcaagggatccgccttcctcagcctcccaaagtgctggaattacaggcatgagccactgcacctggccttacttcacttttcaattatggtgtcttttgtaaaaaagaagtttttaattaaaaaaaaaaagctcccatctctccaaaaataaaaaattagctgggcatggtagctcacacctgtggtcccagctattcgggagactgaggtgggaggattacttgagccgagggggtcgaggctgcagtgagctgtgatctccccactgctctccagcctgggcgacagagcaagaccctgtctcaatcatcatcatcatcatcatctgacaatctttttccttatggcttctgggccaaaggaataaatgaaggtataaggcttgttgataactattaataacacacattaaaaaaaaactatgcataacacacatttgaaatctacagcacattgcctgaagttagcatgttgggttctggctctgtctcttgcttcaacagtgtttagaacgaacagaccagggggatccctcttccagcctgtgatcgcctcccatctccttttcacttgagcctcccagaccatcttcttggcaacctcctgcttctgggcccagccaacaccgtttttgtggatatcttcttcttgtccccaagcatgagctcctagatgtgttagaatgattccacccaggcagaggcagccaccaactgccccgtcaaccggcatctctctggacttctactttggccacgatgacatggctctggaaggtgaactggccaagcatctctggaagatgcaaagccagcgtggcagcctgctcttttgcaggacctgcagatgagatgaatgggataaaaccctggacgccgtgggggtagccctggccctggagaggagcctgaacctgggttctgctgacacagacgtcacctctgggacttcctagagaggcctttcctagatgggggagtgaaactcgtcaagagggtggatgatcacctgacctctgcgggctggccacctggagccgggccaggcaactgtcttttccaaagtctggccaccctcaagcatgactgggagcctagcgagcccagtgacctctgagaggctcctctcaaaggatcagggtttctgcctgcctgagcctccccctccagccactaggcagctttttaaccctggagccctctcccaagcctggatcaaatttgcagggacaaaacgggggcaggggctggggtggggaaatcaaattaatgaccttcttagggtaaggatgttccaggaagaggaaacctgccatcccacaacccctagaccataatagcaattattccctccagggatcaacaaaccagtgacagactctagaaccattgaaatctactgattaaggccaggcgccgtggctcccacctgtaatcccagcactttgggaggccaaggtgggaggatcacgaggtcaggagctcgagaccagcctggacaaaatagcaaaaccccgtttctattaaaaatacaaaaaaaatttagctaggcgtggtggcgggttcctgtaatcccagctactcaggaggctgaggcaggagaaccacttgaacctgggaggcagagattgcagtgagccaagattgtgccattgtactccagcctgggtgacaagagcaagactccatctcaaaaaaaaaaaaagaaaaagaaaactctactgattaatgcctatcttaactccagtgtcagtagtagctttgacaaaggccttttatatcacatggctatactttgccaagcatactgaacactattataattgtttcctaataccccatgtgatacccacatgcttcttcataagtttgtaacacatttaaaaatagcatgacgccaggggtggtggctcatgcctgtaatcccagcactttgggaggctgaggcaggttgatcgcctgaggtcaggaattcaagaccagcctggccaacatagtgaaaccctgtctctactaaaaatgcaaagaattagctgggcatgggctgggcgtggtggctcacacctgtaatcccagcactttgggaggctgaggtgggcggatcacctgagattgggagttcgagacctgcctgaccaacatggagaaaccccgtctctactaaaaatacaaaattagccaggtgtggtggcccatgcctgtaaccccagctaattgggaggctgaggccagagaatcacttgaacccgggaggcagaggttgcggtgaaccaagatcgcatcaatgcaccccagcctaggtgacaagagcaaaactccgtctcaaaaaaaatttaaaaaaatgaattagctgggtgtggtgggcgggagcctgtaatcccagctactagggaggctgaggcaggagaattgcttgaacccaggaggcggaggttgtggtgagccaagatcacgccattgcactccagcctggacaacaaaagcaaatctctctctctcaaaaaaaaaaaaaatcagataatctagaatggtaaaaagaagagagtaaaattacctaaataaattaccaaattcccatcatctggaggtaactattcatagcacagatttttaaaaaatgggttatcatataatgctttctattttttatcctgcttttttaaacttaatttttctacttacattgttttatgctaataaatatatatcttcattgaaataactgcatagctttctgttgtatatatcataatttatttaactcatactaatggggcatttgtaaacaaatctatgatagaaatgcatctcttcatatatatatgtgtgtgtgtttgtgtgtgtgtgtgtgtgtgtgtgtgtgtgtgtatttagagataggctcccactctgctgcccaggcttgtgtgcagtggtgcaatcatagctaactgtaaccttgaattccggtgtcaagtgatcttcccatctcagcctcctgagtagctgggaccacaggcaggtgccaccatgcctggctaatttatttttatttttatttttttgtagagctggggtctcaccatattgcccaggctggtctcaaactcgtggcctcaagtgatcctcctacctcagcctcctaaatcattgggatttagaggcatgagccactgtgcccagtctcttgacatattttgtaaataaaaaacaaggaagaaatatttataacacaggcgtgtgccaccatgcccagctaattttttgtacttttagtagagacagggtttcacaatattggccaggctggtctcaaactcctgacctcaagtgatccgcccaccttggcctcccaaagtgctggcattacaagcatgaggcattgcgcctgaccttaaaggactaatttctttcttttttttcttttcttttgagacaggatcttactctgtcacccagactggagtgctgtgataaaatcacagctcattgcagtctccatgtcccaggcgcaagtgatccacatcagcttcccaagtagctgggactacaggggcacatactacacctggctaatttaaaaaactctttgtagagacaggttcttgccatgtttcccagactggtcttgaactgctgacctcaagcgatctttctgcctcagactctgaaagtgctgagattacaggcatgggccactgcacccactgaaaggactaatttcttcaatatgtaagtggtttctataaatatatgagaaacagattaataacacaataggaaaatggacataggacaggagcaaacaattcacagaaaagaaaattgttcctttttttcttttgagatggagtcttgctctgtcacccatgctggagtgcagtggtggcactatctcggctcactgcaagctccgcctccggggttcacgccattctcctgcctcagcctcccaagtagctgggactataggtgccggccaccacgcccggctaattttgttttttgtatttttagtagagacgaggtttcaccgtgttaaccaggatggtcttgatctcctgacctcgtgatccgcccccctcagcatcccaaagtgctgggattacaggtgtgagccaccatgcccggccaaaaattgttcttaaacacatgacaagatgtgcagcttcacttagcataagaaaaatgaccattcaatgtatgaagtggcattttttaatatttcagattgacaaagataaaacaagactgttaatacttttgtttacaagagtgcagagaaatgcatcctcatgcattgttggtcagtgtaaactggtacaacctctttggaaggcagttgggtaagtagctatgaaaatctcaaatgcagctgggtgaggtgcctgtcatcccagcactttgggagactgaggcgggtggatcacctgaggtcaggagtttgagatcagcctggctaacatagtgaaaccctgtctctactaaaaatacaaaaaaaaaaaaaaaaaattagccaggcatggtggcaggcacctgtaatcccagctacttggaggctgaggcatggagaattgcttaaatccaggaggcagaggtttcagttagccgaggtggcaccactgcactccagtctgggcaacagagtgagactccatctcaaaaaacaaacaaacaaacaaacaaaataaaatctcaagtgcacgtaccgtttgtgccagtaattccacaaccgggaattttacagatactctcacagatgtgaaaaaagaagtatgcgcacagatgttccctgcagtatcgttaataatagaaatacactcaaggccgggcgcggtggctcacgcctgtaattacagtactttgggaggccgagatgggtggatcacttgagggcaggagttggagagcagtctggctaacatggtgaaacccagtctctactaaagatacaaaaattagccaggcgtggcatcacacccctgtagtcccagctactcaggaggctgagttgggagaatcacctcaacctgggaggaggaggttgcagtgagccgagatcacaccattgcactccagcctgggtggcagagagagaccccatctcaaaataaataaaatacaataaaataaaataagaaaggtgaacattagcagcagcaaggcagccatcacctttgctctgtgaagcctgtggtagggatggatatgaattagctgtggtgggagggactgagtaagctctgggaccatgtggctctgctggacacagcaggggaaggcagtggtccaggcttcccaaaaaccagccttgaggaataaagataatgctccgaattttcagaactgctctgctcactctgagtcagagtggaaaatactgactgctgcatctagcaaaggagatgtttcagcactgttttgggaagaagggcctgtagggcttatctgacgagggccttactgtcatctccgcatcatgccaagcagcctttccttagacccagggctcccacccccactttcagattagctgccagcctccaacactctgctgttttcctttcctgagaagcagcccctgtgaaagctgtttttctgagcatcaggcctgagcataatctgctttagcagctgaagtggtctgctcttcttttactgaaagcactttaatacagaaattctgttgaccttttagatttatatatgcttctccctcccctctgggcttttcctggaagtaggttggcaaggtttactggaacagtatggttcctacccccacaccagccaagaccttgagaagagagaaggtgctgagccactcaagcacatggccaggggagcttagaaaaacagggacttccaacctgcctgggcaatatagtgagaccccattctccaaaaacaaggaaaaaagaaaaaagaaaaagagggaccctccaaacacaagcagggagaagctgaagaagtgggtgctagaagagcctggagatgtgtagatggcagcctgtctgctgctctgggccttggccattgcctgtgctgctgatgcttctgccgtctcttcttctttcacaaaactacaagagctcaggttgcggctgctcaaaagcttcccgcaatgtgctgattcactctaagtgtctgctcctctgcagactgacttcatgcacttaaaataattcactcatttcattgttagctctgtcctctccacttgcatttcaggccagagcagtacaatgaggtcccaagctctgtcctgtaaaccacagataaaattctaaggcccctccacaaccatctgaatgggcccctcttcttggctaaggacattcccaaggaaatctgaaaatctagttcaggacatgacggaagagcaggtcacacaagcatcattataacctcctcccttttggaattcaggaaaagccaaccagcattaacatcaacacagatcttaagtctggtaagaaacatttacaatctattttctctgaagtttgctacctggaagcttcatctgcctgataaaaccttggtctcaacaactgcttatcataacccagacattcctttctactgataataactctttcttcttcttttttttttcctagacagagtctcgctctgtggcccagactggagtgcagtggccccatctcagctcaccacaacctctgcctcccgggttcaagtgattcccctgcctcagcctgctgagtagctgggattacaggcatgcacaaccacaaccagccaattttgtatttttagtagacacggggtttctccatgttggccaagctggtctcgaactcctgacctcaggtcatccacccgcctccgcctcccaaagtgctgggattacaggcgtgagccatggcccctaaacaactctttcaaccaattgccaatcagaaaaaatttaaaatctgcatgtgacctggatacactccccacaagaacttcaagttgtcctgcccttccatatggaaccaatgtaagtcctatatgtatttgactgatgtctcatgtctccctaaaatatataaaactaggctgtgtcttagcaccttgggcacctgctctcaggatctcctgagggctgtgtcatgggccactgatcactcatatttggctcagaataaatctcctcaaatacatttttgccaacagtccactgggctcaggtgagcagggcctgaaacagataacatggaaatttataataaaataagggacccatgccttaagacataccacaaagtaaatataacactgtacaggctctctcgggtgaccctggactacagaatgtgggttgtggggagggagagacgtggactttttcctgcaggtcatggcttgggtgcacctagaaacaggccaataccaccccttcttttctggaaaggtggggcctgacagctttgcgtggggaaccagtgtcctgttacagttcaggtctaaaatgcctgctgagtaaataaacatgttgttctcaacctaacccaaaaagcctgatatttgtaggaataaaattgctctttcctaccctgggcaaactgcttccctgacaaatatgctcagtcatggagtggagacagataagtaaagagatgctgggaatagagcagagacagataagtaaacagatgctggggatatgtcatgatacagagccaggccagagtcaagcaaggtgttgcattggcatactgccggcctttcctgcaggaaaaggtgtgaaaaagctcttgaggtgatgggaaggggtgtgctgttttgaaatgggaagataaaaacagagccatgggggttctgcaccatcgccttggaacaaatggtgtctgcctccacatctgcaatgactcagatctctgctctgggcatacttgcagtcaaatcagggctgcccagacatcctgtgtttgtgaaatgctgagaaagactaactggcttccagcagttgcctactcatccaccctcttccaaacacccaggctggggagtaacattttggggatgagtccttgtaatgctgcttctctctggagagcaatgtgtgaaaattgacccaaggagttgtctcatgggatgaggcataattggctgtcttttttcggaacctccttgaggctcatctacccccgtgccctgagctcactggggcctgcctggccaaacagaatatacccattaagggaataaatttccaggccacaataacaagcatcaccactttgaaaagaaaaagccatgaactgaaattcttcaaaataagaatttttaattagcccaataaacacattaaaagatataaggaagatactagaactatgaaacaaatgaacacaaaaacaccaaaaagaaccgacaagaaatactaagttgaaaacataacagttgaggctgggcacggtggctcaagcctgtaatcccagcactttgggaggccaaggagggtgaatcaactgaggtcaggagttcgagaccagcctgaccaatatggtgaaaccccgtctctactaaaaatacaaaaactagccaggcgtggtggtgcatgcctgtaatcccagctactcaggagactgaggcaggagaattgcttgaacctgggaggcagaggttgcagtgagccgaggtcgtgccacagcactacagcctgggtgacagagcaagactccatctcaaaaaaaaaaaaaagaaagaaaagaaaatataacagttaatgccaggtgcagcagctaactcctgtaatcacagcactttgggaggccgaggcgggcagatcacctgaggtcagaagtttgagaccagcctgaccaacatggagaaaccccgtctctactaaaaatacaaaattaaccaggtgtggtggcatttgcctgtaatcccagctactcaggaggctgaggcaggagaattgcttgaatccaggaggtggaagttgcggtgagccaagatcacagcattgcactccagcctgggcaatgagagcaaactctggctcaaaaaaaaaaaaaaaaaaaaggtgggggggcggggctcagtggctcaggcctgtaaccccagctctttggtgtagggaaaagaaagagagatcagactgtcactgtgtctatgtagaaaggaaaggcataagaaattccattttgacctataccttgaactattgctttgctgagatgttgttaatttgtaactttgccctagccacttcgccccagccacttcgccccagccactttgccccaactttgagctcacaaaaacatgtgttgtatggaatcaaggtttaagggttctagggttgtgcaggacgtgccttgttaacaaaatgtttacaagcagtatgcttggtaaaagtcattgccattctctagtctcaataaaccaggggcacaatgcactgtgaaaagctgcagggacctctgcgctgaaaagccggtattgtccaaggtttctccccatgtgatagtctgaaatatggcctcgtgagatgagaaagacctgactgtcccccagcctgacacccgtaaagggtctatgctgaggtggattagtaaaagaggaaagcctcttgcagttgagatagaggaaggccactgtctcctgcctgagataggagaaaaaccaccctatggcaggaggtgagacatgttggcagctatgctgccttgttattctttactccactgagatgtttgggcggagagaaacataaatctggcctacgtgcacatccaggcatagtacctccccttgaacttaattatgacatagattcttttgctcacattttttttttttttttttttgctgaccttctccttattatcaccctgctctcctactgcattcctcttgctaagataatgaaaataataatcaatacaaactgagggaactcagagaccagtgccagtgcatgtccttggtatgctgagtgccggtctcctggacccactgttgtttctctatactttgtctctgtgtcttatttcttttctcagtctctcatcccacctggcaagatatcccacaggtgtggaggggcaggtcacccctttacttttggaagccgaggcagggggatcacgaggtcaggagatcaagaccatcctggctaacatggtgaaaccccgtctctactaaaaatacgaaaaaaaaattagctgggcatggtgttgggtgcctgtagtcccagctactcgggaggctgaggcaggagaatggcatgaacccaggaggcagagcttgcagtgagctgagattgcaccactgcactccagcctgggtgacagagcgagactctgtctcaaaaaaaaaaaaaaaaaaagaaaaaaagaaaaaagaaaacataacagttgtactaaagaacacaaatgattgaataaactgcaggatggacagagctgaggaataaattagtggactggaataacagaaattcccctaaaggaagaagaaaaaagaacaggaaatataaaaagaatatacaaaatagaatataaaaaggaaatataaaagaatagctaagggatatggagaataaaagtgaaatggcaacattcagaagataggattcctggaaagagaaagagaaaaatggagaggaggaaatatttgaaaaaataaagaataaaaaattctcagaattaggaaaaaagatgaaatgtgaacacaagatctgtatacagattattcctcattaaaaataattttggccaagcgtggccaggcgcggtggctcacgaaatcatgccactgcactccagcctgggcgacagagcaagactctgtctcaaaaaaaaaaaaaacaaatttttggccaagcgtggtggctcacgcctgtaatcccagcactttgggaggcccaagaccagaggatctcttgaacctaggagttggagatcagtctgggtgggcaaaaccctgtctctaccaaaaaaaaaaaaaaaaaaaaattagcctggtgtggtggcacaaacctgtaggtaggagggtcgcttgagcctgggagatggaggctgcagtgagccatgatcactccactgcacttcagcctgggcaatagagcaagaccctgtctaaaaaaaaatattttggggaaatttaagaataccagagacaaaaagaacattctaaacatttccagagagtcagagatcacagataaaggaagaagaggcctatttacttatttatttatatctttttgagacagggtctcactctgttgcccaggctggagtgcagtggtgccatctgggttcactgcaacctctgcctcctgagttcaagcgattctcttgcctcagcctcctgagtagctgggactataggcgcccgccaccacgcctggctaattttttttttgtatttttagtagaaacggggtttaactgtgttagccaggatggtcttgatctcctgaacttgtgatccactgcctcagcctcccaaagtgctgggattacaggcatgagccaccacaccagcccggtttttcaatatacttgtccatgggtccctaaatgtcttgtcgtagattctttaaaaagagtgtttccaacatgctgaatcaaaaaaaaaaaaatggtttaactctgtgtaatggatctgttcatcacaaaacttttttacaggtagcttatttctagtttttatcacgggacattcagatttttaatacgggcctcaatgggctccacagtgtcccttcatagattctacaaaaagagtgtttccaccccgcccttcatagattttccataaacagtgttttcaacgtgctgaatgaaaacaatggtttaagtcttttagctgaatctactcatctgaaagcattttcacagatagcttgtttctagtttgtattgagagataatcgatttttcactataggcctcaataagcttctaaatgtccctttgtagattctttaaaaagagtgtttccaaccttgtgaatcaaaacaatggtttacctatgtgagatgaatgcacacatcacaaagcattttcacagatatcttgtttctactttttatcatgggatattcggttttccaccataggcctcactgggcttcataacgttcccttgtagattctacaaaatgaatgttttcaacctgctgaatcaaaacaaaggtttaaatctgtgagatgaatccagacatcacaaaggattttcacaggtaccttgtatgtcgtttttattaagggaaatttgatttttcccaacaggcctcaatgggctctaaatgatcccttcctagattctacaaaaagaatgtttccaaccttctgaatcaaaacaaagtttaactctgtgaaaggaatctgcacatagcaaagcattttcacacattgcttgtttctagttttaatggcaggatattcggtttttcacaatataccttaatgggcttcgaactgtccctttatagattttacaaaaggaatgttttctaactgctggatcaagacaaaggtttaactctgtgaaatgaatccgcacatctaaaagcatttccacagtttgcctgtttctagtttttatcgtggcatattcagattttcactataggcctcaatgtgctttgatacgtcccttcttagattttactcaatgagtgttttctacctactgaattaaaagaaaggtttaacactgtgagatgaatccacacattgcaaagaatttccacaggtagcatctttctaatttttatcgcaaatattcatttttttcacaataggcctcaatgggctctgaagtgtcccttcatagataccacaagaagcttgtttccaacctgctgaatcaaaacaaatgtttaactctgtgagataaatgcatgcatcataaagtattttcaaatataactagtttttagtttttatcatgggatattcagtttctcactataggctgcaatgggctaagaaatgtccctttgtagatactgcaaaaaagtgttaccaccctgctgaatcaaaacaagggtttaactctgtgaaataaatgaacacatcacaaagcattttcacagatagcttttttctaatttttatcgtgggatgctttttttccactataggcctcaatgtgctttgaaatgtccctttctagattctacaaaaaaggtatttaaaacctcctgaatcaaaacaaaagttaaactcagggagatgaatgcacatatttcagagaatttttacagatagcttgtttctagtttttatcacgggatattcattttttcactataggcctcatttggctccgaaaagttcctttgtagtttctaaaaataaagtgtttccaacccgcacttagtagattttactaaaacagtgttttcaacctttttaataaaaacaaaagtttaattatgtgacatgaatatacacatcacaaagtatttacatagatagcatgtttctagtttttatcatgggatatgcggttttttactgtaggcctaaatcagctctgaagtgtcccttcttaggttctagaagaacagtgtatcctacctgctgaaccaaaataatggtttagccctgtgagatgaatccacagatctcaaagcatgttcacagatagcttgtttctagtttttatcatggaatgcttggtttctcattataggcttcactgggctctaaaatatccattcgtagattctataaaaagagtgtttccaacctacttaatccaaataaatgtttcactctgtaaagtgaatccaaacatcacaaagcattttgatggatagcttgtttctagttttaatcatgggatattcagtctttttctgtagacttcaatggtctctgaaatgtcccattgtagattttacaaaaagagtgttgccagccagctgaatcaatacaaacgtttaactctgtgagataaatcttccatcacaaagcattttcacagatagcttgtttctggttttcaaggcgaaatattcagtttttcactataggcctcaatggactccaaaatgtttctttgtagattttacaaaagagtgtttccaacctgctgaaacaaaacaaaggttaaactgtgtgagatgaatccacactttgcaaatcattttcacaaattacttgtttctagtttttatcatggaatattcagttttccactgtaggcctcaatgggttccaaaatgtcccttcgcagatactacaaaaagagtgtttccaacctgctgaataaaaactaagatttagctctgtaaaatgaatccacacattgccaagcattttcaccaatagtttgtttctagttctaattgcaggatattcggtttttcactataggcctcaatggcctccaaaatgtccctttgtagatcccattaaaaggatgtttccaacctcccctttgtagattttacaaaaagagtatttccatcctgctgaataaaaacaaaggtttatctctgtgagatgaattcacacatcatgaaacattctcatatgtagcttgtttcaagtttttatagcgggatatttagttttatgactataggcctcaatgtgctccgaaatgtcactttgtaaactgtgtcaaaagagtatttccaacctgatgaataaaaataaaggtttaagtctgtgagatgaatccacacatcacaaaccattttcacagacagcttgtttctacttttcatcatgggatatttggttattcactatagacttcaatatgctctgagatgtccccttttagttctacaacagagtgtttcaaacctactgaatcaaaacaaagatttaactctgtgacatgaaatgacccattgtaaagcatttttacaggtagcttgttcctagtttttattgcagaatattcagttttttactacaggcctcaatgggctttgaaatgtcctcttgtagattctacaaaaagagtaattttggtctgctgaatcaaaacaaaagttaactctgtgagatacatccacacattgccaaggattttcacagatacatttttctagtttttatcatggaatatttggttttttactacagttctcaatgtactctgaaatatcccttaatatattcttgaataagtttgtctccaacctgctgagttaaaacaaagctttaactctgggagatgaatccacacatcacagcacattttcactgatagattgtttctactttttatcttgggacaatctgtttttgactataggcctcaatgggctttaaaatgtcccctcgtagattctacgaaaagagtgcttcaaacttgcttaatcaaagcaaaggttaaattatgtgagatgaagccacacatcacaaagcattttcacatatagcttgtttctagtttttatcatgggagatttgattttttactataggcctcaattggctctgaaatgtaaacttttatattctacaataaaagtgttttcaacctgctgaatcaaaacaaatgtttaactccatgagatgagtccacacatcacaaacattttcacaagcagcttgtttctaatttttattatgagatattcagtttttcagtacaagcctcaatgggctccaaaatgtttcttcatagattctaaaaatagagttgttccaacctgccaaatcaaaacaaacatttaactctgtgagataaatccatacattgcaaagcattttcacagatagcttgtttctagttgtttattgtgggatattttgtttctcactataaacctcaataggctctgaaatgtcccctcatagattctacaaaaaaagtgctttcatcctgctgaataaaaacaaaagtttaactctgtgacatgaaatgacacatcataaagcatttcgacagagagctttgttctagtttttgtcatggcacattcagtttttcactacaagccacagtgggctccaaaatgtcccttcgtggattctacaaaaagtgattttggcctgctgaatcaaaacaaaggttcaactctgtgagatgaatccacacatcacaaagaattttcacagatagcttgtttctagttttcatcctaggatattagggttttttcatgcatttcttcatgggctctgaaatgctcctttgtagattctacaaaaagtgtttccaacctgctgaatcataacaaaggtttaactctgtgagttgaatccacacatcatgaaacattctcatatgtagcttgtttctagtttttatctcgagatataaagtttttaactgtaggcctcaatgttctctgaaatgtgccttcttagattctacaaaaagagtatttccaacctgttgaatcaaaaccaaagtttaactctttgagatgaattgacacattgcaaagcattttcacagatagcttttttctagtttttgtcacagaaattcaggttttcactgttggccattgtggaccccaaaatggccctttgaagattctacaaaaagagtagttccaacctgctgaatcaaaacaaaggcttaaatctgtgagatgcattcacacattgcaaagcattttcacagatagcttttttctagtttttgtcacagaaattcagtttttcactgttggcctttgtggactccaaaatggcccttcatagattctgcaaaaagagtagttccaacctgctgaaacaaaacaaaggcttaaatctccacacattgcaaagcattttcacaaatagcttgtttctggtttttatcacaggatatttggtttttgactttagacctcaataggctccaaaatgtctcctcctagattatataaaaagattgtattccacgtgctgaatcaaaacacagttaacttggtgagatcaatctgcacatcacaaagcattttcacagatagcttgtttctcgtttttatcacaggatattcagtttttcactataggcctcaaagcacaccaaaaagtcttcttgtagatccaaaaacagactgtttccaacctgcttaatcaaaacaaagatttaactctgtgaaatgaatccacacatcccaaagcattttcacaggtagcttgtttctagtttatatctccagatattttgtttttcactacaggcttcaatgggctttgaaatgtttcttcatagattgtactaaaagagattttccaacctactgaattataacaaagatttaattctgtgagattaatctacacatcacaaagcattttcatagatagcttgtttctagtttttattatggtataatttgtctttcattgtaggcctcaatgggctttgaaatggcccttagtagattctgcaaaaagagtatttccaacctgctgaattaaaataattgtttaagtctgtgagacaaattcacacaatgcaaagcattttaacagatattttgcttgagtttttattgcaggatatttggtgtctcaatatactcttccatgggctccaaaatgtccctttgtatattctacaaaaagagtgtttccaacctgttgaataaaaacaaaggtttaattctgagagatgattccaaacatcacaagacctttggacagatagcttgtttctagttttcattgtgggatattcaacttttcaccgtagtcctcaaggagctttgtaatgtcttttcatggaatctacaaaaacagtgtttccaccctgctgaatcaacacaaatatttaactctgtgagatggatccacacatcccaaaacattttcataaatagtttgtttccatttttcatagaagaatatttgctttttctatatatttatccatgggctccaaaatgccccttcatagattctaaaaaaagaatagtttcaatctgctcattcaaaacatatgtttaataatctgagagataaatccacccatcacaaagcattttcacagatagcctgtttctagtttttaatttcaggatatttagtttttcattgtacacctcaatgggctccaaaatgtcccttcatagattctacaaaaagagtgattccagtctgtggaatcaaaacaaatgtttaactctgtgggatgaatccactgactgcaaagcattttcacagataggttttttctagtttttatcatgggatatttggttttttactcttggcctcaatgggcttcaaaatgtcccttcgtagattatacaaaaagagtgtttccaagctgctgaatcaaaacaaagaattaactctgtgacatgaatccacacatcacaaagcattttcacagatagactgtttctagtttttatcatgggatatttagtttttcactatagacctcaattggctctgaaatgtcccctcatagattcttcaaaaatagtatttccagctctgctaaatcaagacaagagattaactttgtgatatgaatatacatatggcaaataatttttagtgataagttgtttccagtgtttttgatgtgatattcagtttttcactgtaggcttcaatggcctctgaaatgtccacacgtaggtggtacaaaaggactgtttccaacatgctgaatcaaaacaaaggtttaactctatcagatgaatccaaacattgcaaaggattttcacaggtagcttgtttctagtttttatcgtgagatatttggatttttactaatggccctaatggactctaaaatgtcccttcttagattttacaaagagagtgtttccaacctgcttaatcaaaacaaaggtttaactctgtgagatgaatctacacatcacaaagcatttttagaaatagactttttattgttattgttgcaaaatattcagatttttaccgtaggcattaatgggtgttgttgggaaaaggtgagtgttgggagaagctgagacagggcttgcatgtctgacataatgtaaaagagtcttggaacatgtccagggtccagggtctaaaaccccttgtggcatttggaacaccaaagtctgtgctaaagggtggaaggctatccagatgcacaataatctaagcccagggcataaaatccctgatggcagggatagaatccagggtttgtggctttggaatgtgtccagaattgctggatccttgctccttgctctcccagaattgattgtatcttgagttagaagaacctgctctccattatctcaagtagcagagcaaatgctaaaccatcacagctgtaaatcatgtgtttaatgcaacacactcttttgaccacattctcaccacctgtttctttgttggattaccaataaatactacgggcttccagagctcaaggccttcatagcctccatgatcgtgatggaccctggtcccactttacttctcaaactgtctttttctcaatcatttgactccaccggacttcatcaaccccacaacctggtgttgggtctgatcaccccaacaggtgtgatgtatcctttcataaatccatgcattgcaaagtattttcaaagatagcttgcttgtagtttttatcacgggatattcaggttttcactattggcctcaatgggctctgacatgtttcttcatagattctacaaagggagtgtttcaaacctactgaatcagaagaaaggtttaattctgtgagatgaatccacacattgcaaagcattttcacagatacttttcttctagtttttgtcaaaggatattcagtttttcagtataggcttcagtgggctctgaaatatcccttcgcagattctacaaaaggagcgtttccaatctgctgaataaaaacaaaggtttaactctgtgagatgaatccatactactcaaagcattttcacagatggcttgtttctaacctttataatgagacattcaatttttcactattggcctcaatgggctccatagtgtctcttcctagattctacaaaaacagatttttcatttctccaaatcaaaataaaagtttactctgtgatatgaaatcacacatcacaaaggattttcacagatagctttttctagtttttatcataggatattgggtttttgactataggcttcagtggactcttaattgtaccttcttaaatgctacaataaagtattttcaacttgctggatcaaaacaaaggtttgactttgtgagacgaatcctcacatcgcaaagcattttcacccatagcttgtttctagtttttaccgagagatattattttttcactagaggcctcaatgggctcctaattgtccccttgtagattctacaaacaaagagtctaacctgctgaagcaaaacaaagtttaactttgtaagatagacctacacatcacaaagcattttcacagataggttgtttttagtttttatcaagggatatttgatttttcactgtaggtctcaatgggctatgaaatgtcccctctagatccacaaaaaaaagtttccaacctgttgaatcaaaagaaaagttcaacttgtgaaatgaaatcacacatcataaagtattttcagagatagcttctttatagtttctatcactggatatttggtttttcactatagacctcaatgaacttcaaaatgtctctttgtagattctacaacaagagtgtatccaacctgcagaataaaagcaaaggtttaactctgtgagatgaatccacacatcacaaagcattttcagagataattttttttattgtttttatcgcaaaatactcacttttttactataggcttttataggtgtgaaacatccctttgtatattctacaaaaaggtattccaaacttgctgaataaatgcagaggtttaaatttgtgacatgaatccacatattgcacagcatttttactgacagcttttttctagtttttatcacgggataatcagtttttcagtataggcctcaatttggtccgaatagtaccctagtagattgtagaaaaagagggtttccaacctgctgaattacaagaaaggttaaactctgtgagataaaatcacacattgtaaagaatttttagacatagcttctttgtagtttttattacaggacatttgattttttactataggcctcaatgagctctgatatttcccctggtagattgtacaaaaagagcatatccaatctgctgaatcaaaacaaacatttaactctgtaagacaaatctacatatcgccatgcattttcacagatagcttgcctctagtttttatcacgggatatttgatttttcactataggcctcaatgggctccaaaatgttgcttcatagattctacaaaaagagtgtttccaacctgctgaatcaaaagaaaggtttaactttttgagataaatacacgcattgcaaaacatttttacaggtagttcattttagtttttatcatgggatattccatttctcactataggaatgaatgggctctgaaatgtcacttcaaagattctacaaagagagtgtttccaacctgctgaatcaaaacaaacatttaacttgttgagatgaatcctcacatcactaagcattttcacagatagattgtttttagttttatcatgggatattcagtttttgattataggcctcaaagactgaattgtggccaagcagatagtaaaacatatgtgtctccaaccttctgaataaaaatcaaaatttaactatgtgagatacatccatatatcacaaagcatatttacagatagccagtttctagttttaatcatgggatattcagtttttcactacaggccttaatgggctcaaaaaagactcctcttattctactaaatatttgcttccaatgtactgtataataacaaatattaaacgctgtgaaagaaatccacagatcacaatgctttttcacaaatagcttgtttctagtttttatcacaggatatttggtttttcactgtaggcctcaatgggctatgaaatgttcctttgtagattctataaaaagtgtgtttccaacttgctgacttaaaataaaggttttacactgtgagatgaatccacacattgcaaagcattttcacagatagcttgtttctttttcttatcatgggatattcagtatttaactagagacttcaatgggctctggaatgtcccatagtaaactctatacaaagagtgtttccaactggctgaataaaaacaaaggtttacgtctgtgaggtgaatccacacaacacaaagcattttcactgacagcttgtttctagttttatagcaggattttttttcaatattggtctcaatgggctccaaaatgtccctttgtagattctacaaaatttttttccaacatactgaatcaaaacaaatgtttaacactgtgagatgaattttcacatcaaaaagcatttttacagtagtttgtattagtttttattatgaaattttgaatttttcactgctagcctcaaaattgtcccctattagattctactaaaagaatatttccaacctactgtatagaaacaaaagtttaactctgtgaaatgaatccacacattgcaaacctacttcacagatagcttgtgtctagtttttatcaagaattatttggcttttcactataggcctcaatgggctccaaaatgtcccttcatatattttgctaaaagagtgtttccaacctagctgaatcaaaagaaagtttaaactctatgaggtgaaactgcaaattgcaaagcattttcacatatagcttctatagtttctatcatggaatattcagtttttcactatcggcctccatgggctatgaaatgtcccctcgtaggttctacaaaaaaagtgtttctaacatgttgcatgaaaacaaagatttaactttgggagatgaacccacacattgcaaagcatttctatagaaagattttttctagtttttatcacaggatattagatttcatactgtaggcctcattttgctccaaatttaccccttgtcaattctacaaagagaatatttccaacctgctgattcaaaacaaatgttcaattctgtgagatgacatgcaaagcttttcacagatagcctgtttctagttttcatcataggacatttggtttttcactataagcatcaaagggctctgaaatgtccctttgtagattctacaaaaagagtgttcccaacctgatgaatcgaaagaaaattttaactttgtaagatgaatccacacatcacaaagcattttcactcatagcttgtttctagtttttatcgtgggttattggttttcactaaatgcctcaatgagctatgaacagtcccttgtagattctacaaagaaagaatttccaatctgctgaagcaaaacaaagttttaactttgtaagatgaatctacacatcacaaagcatttttacaaaaggttgtttttagtttttatcaagagatattctatttttcacagtacacctcaatgtgctacaaaatgtcccctagtagattctacaaaaaaactttctaaactgctgaatcaaaagaaaagttcaactggtgagatgaaatcacacatcacaaagtattttcagagatagcttctttatagtttttatcatgggatattagatttttcaatataagcctcaatgagctctgaaatatccctttgtagattctacaaaaaaagtgtttccaacctgcaaaataaaaaggaaggtttaattctgtgagataaatccacacattgcaaatcatcttcacagttggcttgtttctaatttttattgtggaatatttggcttttcactgaaattctcaagtgctctgaaatgtccctttgtagattctataacaagagtgttttcaaactgctgaatgaaaacaaaggtataacgctttaagaggaatccacacatcacaaagcatatattcagatatcttgtttctagtttttaaagcatgatatttggtttttcactataaccctcaatgggctcagaaatgtctcatagtagattttacaaaaacagtatttcctacctgctaaatcaaagcaacagcttaaatctgtgagattaatccaaacctcgcaaagcattttcacagatagcttactcctagtttttatcgcaggatatttggattttcagtataggcttcaatgggctctgaaatgtccattcataagttatataaaaagtatgttcccaaacccctgaaaaaaaaatgaaggtttaactctatgagatgaatccacacgatgcaaagcattttcacagatagcttgtttctagcttttatgatgagacattcgaatttttactattggcctcaatggggtcagaaatgtctttttgtagattctacaaaaaaaaaaggcttttatttttctgaatcaaaataaaggtttaactcttctatatgaaatcacacatctcaaagtattttcacagataacttgtttctagtgtttatcactggatattgggtttttcactataggcttcagtggactcttaattgtaacttcttaattcttcaaaaagtgtgtttccaacctgctgtatgtaagtaagtgtttacctctgtgagacaaatcttcacattgcaaagcattttccccaatagcttgtttgtagttttaattgcataatatttggttttgtactataatcctcaatgggcaccgaagtgtcccttcgtagattatatgaaaacagtgtttctaacctgttgaatcaaaacaaaggtttaactgtcagatgaatctacacattgcaaagcattttcacaggtagcttgtttcaagttttcatcgcaggatatacgtttcttcattataggccccaagagctccaaaatgtcttagagtatttcaaacctgcagcataaaaacaaaggtttaactttgagacaaatgcatacatcacaaagaattttcacagaaagcttgtttctagtttttatcaggagatactcagtttttcactatagacctcaaggggctttgaaacatcccttcatagattacacaaaaagattgtttccaccttgctgaaacaaacaaacaaaaaattaactctttgagatgaatcaacacattgcaaatctattcacagatagcttgtttctagtttttttttttttttttttgaagggtattctgtttttcactataggcaccaataggctcctaaatgtccctccgtagattctacaaaaagagtgtttccaacctgctgaaccaaaagaaaggtttaattctatgagatgaaatcatgcacaagaaagcatttttttgagataccttttttatagtttttatcactggatattctatttttcacagtaagcctcaatgggctttgaaatatctctttgtcgattgtaccaaaggagagtttccaatttcctgaatcaaaacaaaggtttaatgttgtgagataaatccacaaattgcaaaacattttgacagaaaacttgtttctagtttttatcacaggatatttggttttcattataggcctcagtgggctaagaaatgtcccctcatcaaatctacaaaataggtttctccaacctgctgaatcaaaattaacattcaactctgtgaaatgaatccacacatcacaaagcctttttttttttgatggaatctcactctatgacccacgctgccgtacagtggtgtgacctcagctcacagcaacctccacctcctgggttcaagcaattctcctgcctcagcctcctgagtagataggagtacaggcacacaccaccatgcccagctatttttttttttgtatttttagtagagacagggtttcaaaatgttggccaggctgctcttgaactcctgactgcaggtaatccaccagcctcagccttccaaagtgctgggattacaggtgtgagccactgcacccagccacaaaacattttcacagatagctagtttctagtttttatcaccagatattcagtttttcactattgtccacagtgggctttgaaatgtccccttgtagattctacaaaaatagtgtttttgacctgccaagtcaaaacaaatgataaactctgtgagatgaaactacacatttcaaaacatttttacagatagcgtattctagtttttaatcatgatatattcactttttcactctaggccccaatgggcttggaaatgttttttcattgattctacaaaaaaaaattgtttccaactttttaaatcaaaacaaatatttaactctgtgagatgaattcacaaatcacaaaatattttcacagataatatgtttctagtttttatcaagggttgttcttttttttattgtaggcctcagtgggctctgaaatgtccccttatagattttataagaaaagtttctccaagctgctgaatcagaagaaaagttaactctatgagataaaatcacacatcacaaagcattttcagagatagttttttaaatagtttttatcattaaatattcattttttcagtatttgcctccatgggctctgaaaagtactatcaaagagtaaacaaaattagtgtttccaacatacttagtcaaaacaaaggtttaactctgtgagatgaatccacacattgcaaagcattttaacagatagcttgtttctaatatgtatcatgggatattcagtttttcaatataagcctcaaagggttctgaaatggaacttcttagattctacaaagagactgttttcaacctcctgaataaaaacaaagatttaactccatgagatgaatccacacatctcaaagcattttcacaaatagattttatctactttttatcatggaatattgggtttttcacaataggcttcaatggactctatatcatcccctattaaattctacaaaatgagtgtttccaacatgctgtatataaacagaggttaactctttgagatgaatctatatacacaaagcatttgcacagagaacatgtttctagttttcgtagtgaaatattcagttttcagtctataagacctcaatgggctctgaaatgtcccttcatagattgtacaaaagtgggtttccaaactgcagaatcaaaacaaaggtttaactctgtgagatgaatccacacaacacaaagcattttcactaataatttgttgctagtttctatcatgggatatttggtttgtcaatatgctcatccatggaaaccaaaatgttcctttgtagattcttaaaaaaaaagtgtttccaatctgctgaatcaaagcaaatgtttaactctgagagatgatccacacatcacaaagcattttcacagaaatcttgattctcatttttatcagggaatatttagtttttcaccataggcctcaatgggctttgaaatgtcccctcttagacaaaaaaaaaaaaaaaaaaaaaaagtgtttccaacctttgaattacaactaaggtttaactctatgagatgaatccacacattacaaagcattttcacagatagcttgtttctagtttttatagagggatatccagtttttcactatatgcctcaatgggtttaaaaatgacccttcatagattccacaaaaagagtgtttccaaactgttgaatcaaaacaaagttttaactctgtaaaatgaatgaacatatcacaaagcatttttgtagatagcttgtttctagtttttatcacaggatattctggttttcactacaggcctcaaagagctccaagatgtcccttcatagattctacaaaaagagtgtttccaacctcctcaatctaaagaaaaatttaactcattgagatgcccacattgcaaagcattttcacacacagctcctttctagtttttttgctggatatgcggttttttcactataggcctaaacaggctccaaagtgtcccttttagattctacaataacagttttttctacctactaaatcaaaacaaaggtttaactctgtgagatgaacccacacatcgcaaagcatgtttacagatagcttgtttccagtttttatcatgggatgttggatttttcactgtagacctcaatgggctctgaaatgtccccttgtagatcctacaaaaagagtgtttcctacctatgaaatcaaaacaaaggtttacctctgtaaaatgaatgcaaactgcacaaattattttcacagatagcttgtttctagttttaatcacgagatattcactcttacaccataggcctcaatcagcttagaaatgttgccttgtagattctacaaaagagtgttttcaacctgctgaatgaaagcaaaggtttaactctgtaaaatgaatgaacacattgcaaagcattttcacatagagtttgtttctattttttttttgtgggatattttgttttccactctaggcctcaataggctctgaaatgtcccttcacagattctacaaaaagagcatttctaacctgctgaataaaaacaaagatttaactctgtaaaattaatccacacatcagcaagtattttcacggatagcttgtttctagcttgaatcacgaaatattaggttttttattatagacctcaatgggctccaaaaaggccctttgttcattccacaaaaaaaagcatttccaacctgttgaatcaaaacaaaggtttaactccatgagatgaatccacacattgccaatcaagttcacacatagattgtttttagtttttattgtgaaatattcaattttttactgtaggcttcaatgatctccaaaatgtattttttgtgtattctacaaaatgattgccccaactttcttagtgaaaataaagtttaactctctcagataaatccacacattgcaaagcattttcacaaataaatagttgttagtttctatcataggatatttggtttatcaatatatatgcacatgggctccaaaatatccctttgtcaatgcttcaaaaagggtgttcttaaactgctgaatcaaaacaaagttttaattctgagacccacatattagaaagcattttcacagatagcttgattctagtttttatagggaatattcagtttttcaccataggcctcgacgggctccaaaatgtccctttgtagattctacaaaaaaaaagtgttcccagcctgttgaatcaaaaccaaagtttaactttgtgagatgaatccacacatcacaaagcattttcacagatagcttatttctagttttcattgcaggatattcagtttctcaatatagtcctccttgggctctgaaatgttgcttcatggattctaaaaatatagtgtttccaacctgctgattcaaagcaaaggtataattctgtgagagaaatccacacatcacaaagcattttcaaagacagcttgtttctagtttttaacatgggatattcagtttttcagtataggcctcaatttgctccaaaatgtcttttcgtagattcaagaaaaagagtgtttccaacctgctaaatcaaaagaaaggtttgactctgtgagataaaatcacacattacagagcattttcagacatagcttttttatagtttttattatgggacatttggttttttactatatgcctcaatgggctccaaaatatcccctcatagactgtacaaaagagcatttccaacttactgaatcaaaatgaaggtttaactctgtgagatgaatttactcatggcaaaaaattttcacagatagcttgctttgtgtttttatcacaggatattccgtttttctccataagcctcaatgggctccaaaatattcctttgtagattttacaaaaaaagtgtttcaaaactactgaatcaaaaccaaagtttaactctgtgagatgaatccacacatcgcaaatcattttcataaatagcttttttctagtctttattgtgggacatttgattttttgccataaacctcaatggattctgaaatattgttttgtagattctataaaatgagtatttccaacctgctgaatcagaagaaaggtttaacactgtgagatgactccacacatcacaaagcattttcacagatacattgcttctagtttttcttgtgagatattcggttttcactataggcctcaaatggctctgaaatgtccctgcttagattctacaaaaaaaaagtgtttccaacctgctgaatcaaaacaaagttttaactctttgagataaatccacacattgcaaagcattttcacagatagatgtttctagtttttatcgtgggatattgatttttcactacatgccaaaatgggctccaaattgtccccttgtagaatctacaggcagggcattttcaacgtgctgatgcaaaacaaagttttaactgtgtgggatgaatctacacatcacaaagcatttttacagataccttgtttctagtttttatcacagtatatttggtttatcactatatgcctcagtttgctctgaaatgtcctatcatatattctacaaaaagagtgtttttttgtttgtttgtttgtttgttttgttttgttttgtttcatttttgagaatgagtctcgctcttttttgcccaggctggagtgcagtggtgtgatcttggctcactgcaagctccacctcccgggttcatgccattctcctgcctcagcctcctgagtagctgggactacagatgcctgccaccacacctggctaattttttgtatatttagtagagacagggttttcaccatgttggccaggatggtcttgatctcttgacttcgtgatccaccagcctcggcctcccagagtgctgggattacaggcatgagccaccatgcccagccaaaaagagtgtttttaacctgctgaatcaaaagaaaggtttaactctgtgaggtgaaattacacattgcaaagcattttcagagataacttctttattgtttttatagtgggatattaggtttttcactataagcctcaataggctttgaaatatctcccagttgattgtaaaaaaaagagagtttccaaactgctgaatcaaaacaaaagtttaacgtcatgagataaagccacaaattgcaaagaattttcacagataacttctttctggtttttatcacaggatattcagtctttcactatagtcctcagctgactgagaaatgtaccctcataggttctacaaaaagagtgtttccaacctgctgagtcaaaacaaaagttaaaatctgtgagatgaaatcacatattgcagaacatttttacagagagcttgttctagtttttagcatggcatattcggtttttcactataggcctcaataagctctgaaatgtcccttcatagattctacaaaaagagggtttccaacctgctaaatgaaaagaatagtttaactctgtgacatgaatccacacattgaaaaacattttcacacatagcttgtttctagtttttatcacgggatatccagtttttttagtacaggccactgtgagctccaaaatttacttctgtagatgctacaaaaagagtgtttccaaccttctgaatcaaaacagaggtttaactttgtgagatgaatccacaaatcttaaagcattttcacagataatgtttttttcagtttttattggggatatttggttttacatgataggcctcaaaggactcagaaatttcttcttttagattctactaacagagtgttgccaacctgctgtatataaacataggtttaactctgtgagataaagccacacatcacaaacattttcacagttagcttgtttctagtttttatcaaaagatatttggtttttcactataggttctaatgggctctgaaatgtctcctcatagattatacatcagtttacaaactgctgaatcaaaaacaaaaaagggtttacctctgtggaataaatccaaacatttcaaagataattcacaggcagcttgtttctagactttaccatggcatattggtttttcactataggcctcaacaggctcggaaatgttttttggttgattctacaaaaaaagtgtttccaaccttttgaatcaaaacaaagtttaaactctgtgagatgaattcacacatctcagtgtgttttcacagatagcttgtttgtagtttttgtcaagggatattcatttatttattgtcacactcactgagctctgaagtatcccctcatagattccacaaggaaagtgtttacaaactgctgaatcagaagaaaagtttaactctgtgagatgaaatcacatgtcataaagcattttcagagatagcttctttatagtttttatcaagatatattcagtttttcagaattggcctcaaggggctccaaaatgtcctctcgtagagtctacaaaattagtgtttccagactattgaatcagaacaagggtttaactctgtaagaaaaatccacacattgcaaagcattttcacagatagcttgattctagtttttatcagggaatatttggttattcaccataggactcaatgggctttgaaatgtctcttcttagattctacaaaaaaagtgcttccaaccttctgaattaaaagtaaggtttaactctatgagatgaatttgcacatcacaaagcattttcacagatagcttgtttctagtttttatcatgggatatctggtttttactataggcctcaatgggcttcaaaatgatccttcatagattctactaaaagagtgtttccaacctgtttaatagaaacaaatgtttaattatgtgagatgattccacacatggtgaagcattttaccacacagcttgtttctagtttttattggttttttactataggccttcatgggctccgaaatgtcccttggtggattctacaaaaagagtatttaccgtctgctgaatcaaaacaaggctttaactctgtgagatgaatccacacatggcaaagtgtttttacagatagtttgttttcagtttttattgggaaatatttggtttttcttaataggcctcaaagggctcagaaatgtcttttttctaattctactaaaagagtgtttccaacctctgtatataaacataggtttaactctgtgagataaatccatacattgcaaagctaattcacagatagcttgtttctaatttttatcaccagatattggtttttcaatataatctttgagatcaactcacacattgcaaagcattttcacagatagctttttttagtttttatcaagggatattcactttttattgtaggactcaataggctctgaaatgccctttcatagattctacaaaagaaattgtttccaacctgctgaatcaagaaaagttaaactccgtgggatgaaatcacacatcacaaagcattttcagagatagttttattatagtttacaccacaaaatatttggtttttcagggttggcctcaacaaaattttaactctgtgagatgaatccacacatcacagagcatttttcacaaatagcttttttctggtttttatcgtgggataactggtttttcaatataaacatcaatgggcttcaaaatattcctccttagattttactaagagactattatcaacttcctaaatacaaacaatggttaaatcagtaagatgaatccacacattacaaagcattttcacagataaactttttttactttttctcacagaatattgcattttttcactataggcctcaatggactctaaattgccctctctcacattttacaaaaacagtgtttccaacctactgtatataaacaaaggtttacctgtctgagtagaatctacacacgcaaagcattttcctagataacgttttcagttttcattgtgaaacaatcagtgtttcactataggtctcaatgggttccaaaatgtcccttcgtagattctacaaataaggtgtttccaacctgctgaaacaaaactaaggtttaacactgagagatgaatccacacattgcaaagcatcttcacagatagcttatttctagtttttatcatggaatatttggttttacactataggactcaaagccctcagaaatttattcttttagattcaagtaaaagagtttttcatacctgcagtataaaaacaaaggtttacttctgtgggataaactcacacattgccaagcatattcacagatagcttgtttctagtttttatcacaggatgtttagtttttcactaaggctcaatgggctttgaaacattcctctgtagagtgtacaaatttgacctgctgaatcaaaacaacgtttaactttttgagatgaatccacacatcacaaagcattttcacagaggcttgtttctagtttttattgcaggatattggtttttctctacaggtcaatattgtctttgaattgtcccctcatagattctacaaacaccgagcttccaagccaatgaagcaaaagaaagtttaactttgtaagatgaatctacatattgcaaagcatttttaaaagatagcttgtttttagcttttattgctggatattcagtttttcactgtaggcctcaatttgctctgaaatgttttattgaagatctacacaaagagtgtttccaaccactgaatcaaaagaaacgtttaactctgtgagattaaatcacacattgcaaagcattttgagagacagcttcatatagatttatcatgggatatttggtttttcactgtaagcctcaataagctttaaaatgtctcttcatagattgcacaaaaaaagagtttccaacctgctgaaaaaaaaagttttaacgttgtgagatgaatccacctattgcaaagcgttttcacaaatatcattttttctagttttcatcgtggaatattgtttttaagtgtaagcctcagtgggctcaaaaatacccctcatagattctacaaaaagagtttttctaacctgctgaatcaaagcaatagttcaactctttgagttgaatccacacatcacaaagcaatttcacagatagcttgtttccagtttttatcacgagatatttggttttttactgtaggcctcactagctcagaatttttccctcttagattctactaaaacagtgtttccaaaatgccatataaaaataaagttttaactctgtgtgatgaatctacacattgcaaaccattttcagacatagattatttctagtttttatcatgagatattctgtttttcactataggcctcaaaggtctccgaaatgtccctttgcagattctacaaaatgagggttttcaacctgctgaatataaagagaggtttaattctgtgagataaatccacacatcacaaaacattttcactgatagtttttttcaagttttttatcgtgtgatatttgatttttcactataggcccaatgggatccaaaatttctctttgtagattctataaaaaagtattttcaacctgccaaatcaaaacaaggttttaactgcatgagatagatctacacatcataaagcattttcacaaattgtttgttctagtttttatacggggatattttgttttttactataggccacagagagctcagaaatgtcttcttttagattctgcaagaagaatgttttccacctgctgtatataaatataggcttaactctaggagaaacatctgcacatcacaaacattttcacagatagcttgtttctagtttttatcacgggatatttggtttctcactagaggcctcaataggcccctaagtgtccctttgtagattctaaaaaaaagtttccaatttgctgcataaaaacaaaggtttaactctgtgagatgtgtgcacacatcataaagcattttctcagaaggattatttttagttttttcatgagatactctgtttttcatttgaggccacattgagatctgaaaaatccctatgtagattctacaaaaagagtgtttccagcctgcagaatcaaaccaaggtttaattctgagagatcattccaaacatcatgagacacttttacagataggttgtttctaggtttaattgtgggatattcagttttttaatataggcctcaaagggctctgaaatgtcccttcatagattctatgaaaagagtgtttccaactggctgaatcaaaacaaatgtataactctgtgagagaaatccacacatcacaaagcattttcactgacagcttgtttcaagtttttattgcaggataatcagtttttgactataggcctcaatgggctttaaaatgtaccttcatggtttctacaagaagagtgcttcaaacctgcttactcaaagcaaaggtttaattctgtgagatgaatccacacatcacaaagcattttcacgtatagcatgtttctagtattgatcactggatatttggtttggtttttcactgcagacctcaataggctctcaaatatccccctcatagattctacaaaaagaaagtgctttcaacctgctgaatcaaaacaaagttttaactttgtgacatgaaatgacacatcataaagaattttcacagatagcttggttatggtttttatcgtgtgtattcatttttccactacaggccacagtgggctccaaaatgtccactcaggcctacaaaaagagagatttttgcctgctgaatcaaaacaagggtttagctctgtgaggtgaatccacacatctcaaagaattttcacaaataccttgtttccagttttcgtcacaggatgttggtttttttcatatgcttcttcatgggatctgaaatgtcccttcatagattctataaaaagaatatttccaaccagctgaatcaaaacaaaagcttaactctgtgagttgaatccacacatcacaaagcattgtcatatatagcttgtttcaagtttttatcttgagatataaggtttttaactgtagggcccaatgttctctgaatgtgccttcttagattctacaaaaagagtgtttccgacctgttgaatcaagatagaggtttaactctgtgacatgaattgacacattgcaaagcgttttcacagatagcttttttctagtttttgtcactggatattcagtttttcactattggccttagtggattcccaaatttcctttcatagattctacaaaaagagtgtttccaatctgctgacaaaacagagctttaaatctgtgagatgtatccacacattgcaaagcatttttacaaatagcttgtttctagtttttatcacaggatatttggttttccactatagacctcaataggttcccaaatgtccccttgtagattgtacaaaaggagtgctttccatgtgctgaatcaaaacaaaggttttactccatgagatgaatccacacattggaaagcatttccacagatagcttgtttctcatttttattgtgaaatatttggtttttcactgtaggccttaatgtgcaccaaaatatcttctcgtaggttctacaaacagactgttcccaacctgcttaatcaaaacaaaggtttaactccgtgatatgaattaacacattctaaagcattttcacagatagcctgtttctagtttttatttccacttttttttcactattggcttcaatatgctttaaaatgtttcttcatagattctacaaaaagagttttccaaactgctggattaaaacaaaggtttaactttgtgagataaattcacacatcacaaaacatttttgcagatagcttgtttctagtttttatcatgggatatttggtctttcactgtaggcctaaatgggcttcaaaatggcctttagtagattctacaaagagagaatttccaatctgctgaatgaaaaagaatgtttaactctgtgagattaatccacacaatgcaaaacattttcagaggtagcttgtctttagtttttattgcaggatatcggtgtttcaatgtacttgtttatgggctccaaaatgtcccattgtatattctacaaaaagagtgtttccaatctgctgaataaaaacaaaggtttaactctgagagatgattccacacatcacagtacctttttacacatagcctgtttctagttttcattgcaggatatttagcttttcactataggcctcaatgagctttgtaatgtcctttcatataatctacaaaaagaggatttccagccttctgaatcaaaacaaacatttaactctgtgagatggatccacacatcccaaagcattttcatagatagcttgtttctactatttatcaaaggatattcgctttttctatttacttctccatgggctccaaaatgtcccttcatagattccacaaaaagagcatttcctaaatgctaaatcaaaacaaaggtttacctctgtgagttgaatccacacatttcaaagcattatcacagatagcttgtttctcatttttaatgcggatattcagtttttactataggcctcaatgtgcaccaaaatgtcttgttgtagattctgcagactgtttacaacctgcttaatcaaaacaaagttttaattctgtaatatgaatccacacatcacaaagtattttgacggatagcttgtttctagtttttatctccacatattttgtttttcactgcaagcttcaatgggctttgaaatgtttctttgtagattctacaaaaagagattttttttaacctactgaattaaaacaaaggtttaactctgtgagatgaatccacacatcatgaagcattttcacagatagcttgcttctagtttttatcgcaggatatttgttctttcactgtaggcctaaatgggctccaaaatggcctttagttgattctacagagagagtgtttccaacctgctgaatcgaaataaatatttcactctgtgagatgaatccacacaatgcaaagcattttcagaggtagcttgtttttagtttttattgcaggatattatattcagtgtttcaatatactcatttatgggttctgaaatgtcccttcatatattccacaaaaagtgtttccaacctgctgaataaaagcaaatgtttaactctgagagatgattccacacatcacaatatcttttgatcgatagcctgcttctagtttcatcacgggatattcagcttttcaccataggcctaaataagatttgtaatgtcttttcatagaatctacaaatagagttcttccagcctgctgaatcaaaacaaacatttaactctttgagatggacccacaaatcccaaagcattttcatagatagcttgttcctactgtttatcaaagaatattcactttttccatttatttctctatgggctctgaaatgtccctttatagattctacagaaagagtgtttcctattggctaaatcaaaacaaagttttacctctatgagttgaatccacacatcacaaaggattttcacagataatttgtttctcatttttgatatgggatattcagtttttactataggcctcaatgtgcaccaaaatgtcctgtagattctacaaacagactgtttacaacttgcttaatcaaaacaaagttttaattctgtgatatgaatccatacattgcaaagcattttgacagcttgtttctagtttttatctccacatattttgtttttcactacaggcttcaataggcttttaaatatttatttgtagattatacaaaaagagtttttttaacctgctgactgaaaaaaaggtttaactctgtgagatgaatccacacaatgcaaagcattttcatagatagcttgtttttagttttcatggcaggatatttggtcttttactgtaggcctcaatgggctctgatatggcccttagcagattctacaaaaagagtgtttccaacctgctgaatcaaaataagtgtttaagtctgtaagatgaatccacacaacaaaaagaatttttacagatagcttctttgtagtttttattgcaagatattcaatgtttcaatatactcatccatgggctccaaaatgtttcttggtatattctacaaaaagaacgtttccaacctgctgaataaaaacaaagatttagctatgagagattattccacacatcacaagaccttttgacagatagcttgtttctagttttcatcatagatagtcaacttttcactacaggcctcaattaactttggaatatcctttcatagaatctacaaaaagagtgtttccagcctgcaaacaagggttaaccctgtgagatggatccacacatcccaaaccattttcacaaatagcttgtttctccttttcatcaaaggatatttgctttttccatatacttctccatgggctctgaaatatcacttcacagattctacaaaaagagtttccaacctgctgaatcaaaacaaaggtttaactctgtgaaatgaatccacacatttcaaagcattttcacagatagcttttctctattttacgttgcgggatatttgattttttgctatactcgtccacgggctccaaaatgtccttttgtagatactacaaaaagagtctttttaatctgctcaatcaaaacaaatgtttaactctgggagatgaatctctgcatggcaaagcatttttatagatagcttgtttctagttttccttgtgggatattcagtttttcactgtaggcctcaatgggttctgaaatgtcactctgtagacaaagggacaaacagagtgattccgtcctgctgaatcaaaacaaaggtttacctttttgtgatgaatccacacatcgcaaagcattttcacagtttctttctagtttttatcgtgggatattcagtgttttactcttggccttaatggactctgacatgtcccttcatagattctataaaaagagtgtttccaacctgctaaatcaaaacaaatgtttaactctgtgggaagtattgacacatcacaaagcaatttcacagatagcttgtttctagtttttattgtgggatatttggtttttcaccgtagaccaaaattggctccaaaatgtacccttgcagattctacaagaagagtgtttccaactgctgaatcaagacaaaggattaactctgtgagataaatatacacatggcaaagagtttttagtgataggttgtttctagtttctttagtgggatattcaatttttcactgtaggcctcaatggcctctgaaatgtcccacagagatggtacaaaaagactgtttccaatgtgctgaataaatacaaaggtttaactctatcagatgaatccaaacatcacaaagcattttcacaggtagcttttttctagtttttattgtgggatgtttggtttttcactattggccctaatgggctccaaaatatcctttcttagattctacaaagagactgtctacaacctgcttaattaaaacaaagatttaactctttgagatgaatccacacatcataaaacattttcagagatagaatttttgttatttttattgcaaaatattcggttttttactataggcatcaatgggtatgaaatgtcctttgtatattctatttaaaaaagtttttttttaacctgttgaataaatacaaaggtttaactctgtgagatgaatccacatattgcaaagcattttcaaagatagattgtttctactttttattgcaggataatcagtgtttcactatgggcctcaatgggcttcaaaatatccctttgtagattttacaaaaagatattttccaatctgctgaatcaagacaaaggattcaatctatgagatgaatccacacattgcaaaaaatttttacttagaggctgtttctagtttttatcatgggataatgggttgttcatcaacgtgctgaatcacaaaaaggtgtaactctgtgagatggaatcacacattgcaaataattttcagacacagttatttgttattgctataatgggatgttcaacttttctctgtaggcttcaacaggcttctaaaactcttttcatagattgtacagaaagggtgtatccaaagagctgaatcaaaacaaaggtttaattctgtgagataaatccacacatcacaaggtattttcacatatagcttgtttttagtttttattgtgtgatgttcggtttgtcaatgggctctgaaatgtttctttgttgaatctacgaaaggaaagttttcaatctgctgaatcagaaaaaaggtttaactctgtgaaatgaatccacacaatgtaaaacattttcacagatggcttgtttctagtttttaccatgggatattcggtttttcactacaggtctcaatgacctccaaagtgtcccttcttagatcctccaaaaaaattgtttccaacctgctgaataataacaaaggtttaactctgtgagctgaatccacacatggcaaagcgtattcagagatatattttttattgtttctattacaaaatattggtttattactataagcatcaatgggtgtgaaatgtccctttgtatactctataaaacaagtgttcacaatctgctgagtaaaagagaggtttagctctgtgagatgaaatcacacattgcaaagcattttcagacatagtttctttttagtttttattgatgaacattcgttttttcactatacttctcaatgggtctatgtacctttgtagactgtacaaaaagagtgtatccaacttgcagaatcacagcaaaggtttaactctgtcagataaatccaaatatcacaaagtgttctcacagatcacttgcttctagtttttatcatgagatattctgtttttcactataggcctcaatgggctctgaaacatgttttcctagattctacaaaaaaaagtgttaacaatctgctgaatcagaagaaaggtttaacactgtgagatgaatccgcagattgcaaagcattttcacaaaaagctttcttttagtttttttattgaaaatattcagtttttcactataggcctcaatgggcttccaaataacttttctgaaattctacaaaaaaagtgtttccaacctgctgaatgaaaacaaaggtttaactctgtgagatgaatccacacattgcaaagcatttttacaaatagggtttctagtttttatcgtgggataatcaatttttcactataggccttaatgaactacgaaaaggctcttcatagtttccacagttaaagtgtttgcaacctgttgaaacaaaacaaaggtttaactctgtgagatagatccacacattgcaaaacattttcactgatagcttgtttctagtttctatcacaggatacacagtttttcactatatgcctcaatgggcttaaaaaagttccttcgcagattctacagaaagagtttttccaacctactaaaaaaaaaaaagtttaactctgtgagatgaattcacacatagcaaagtgttttcactgattgcttgtttctactttatatcgtgaaatatttggttttttagtataggcctcaatgggctctgaaactttccttttcagattctacaaaaagagtgtttttaacttattcaatctaaagaaagttttacctttgtaagatgaatccaaacatcacaaagcatattcacagatagcaagcttttagtttttatcacagaatattttgtttttcactatatgcctcaatgggttccacaaaatttattagtagattctacaaaaggagtgtttccaacctgatgaatcaaaaaaaaggtttaattctttcagatgagcccacaaatccgaaagcattttcacagatagcttgtttctagtttttaccatgggatatttgttatttcactataggactgcatggactccgaaatgtctcctcgtagatcctacagaaagagtgtttccaaactactgaattaaaacaaatgtttaaatgtgtgacataatttcacatatcacaaagcattttcacagacagcttgtttgtagtttttatcacaggattttcagtttttcactataggcctcaatgtgctttgaaatgtctcttcttagattctgcaaaaaacatgcttccaacctgctgaatcaaaacaaaggtttactctgtgagataaatacacacattctaaagccttttgacagacagcttgcatgaagtttttatcaggggatattatgtttttctcaatgggtatcaaagggctgccaaatgtcccttcacagattctacaaaaaaagtcttaaaaactgctgaatcagaacaaagatttagcttcataagatgaatccagaaatcgcaaatcatttcactgaaggcttgtttctagtttttatcacaagataatcagttttttactataggcctcaatttgctcaaaaatgttccctcgtagattctagaaagaaagtgtttctgacctgctgaatctcaggaaaggctaactctgtgagatgagatcagacatcagaaagcattttcatacatagcttctttgtagtttttatcccaggatattcagtttttcactatatgcctcaaaaaattttgaaatgttccctcatagacagtacaaaattatgagaggacatttcaaatgaggggacatttcaaaagattgtacaaatctatgaggggacattccaaatgaggggacatttcaaaagagtgtatccaaccttctgaatcaaaacaaatgtttaactctatgtaataaatccacacatcacaaagcattttcaccatatcccccaaaaaggaaactcttgttctcctactcctattggagggctgcatgattcctataggatgaaaagcaggcagccatggctggcttttgcctggtaatctaggctctgtttcatttcatctgcacgtcctttctcatagtggagaggctctttcattgggctgttgctgggtgggactgcctctcgccacagttctattggctgccggggatttcagggagcaaaagggacttcgggtaggcaggccatgctccaggttgtgtattatgatctcgttgtggtgcctgaggttgtttgcactttgcaggagacttttgggtcctctgacaggaatccttgaacgttgcttggactccagcacaagtcagctcgttctctcatgcaaaccttgattttcctttgttttcatgggggcggggggggtcaacagtgcccctcaacagcactgctggacacccttttcatgcttgcaatcgccacagacggcctctgagacaatgtctcaacctcctctgcacccgtgagaggccagttcaaggtgtgagaacactgctacgccttggacttgcctttgccgtagttcctgcctttcccagagagcccctgcgaggcccaggatgaagggaggcaatgaggtcaaaggcccggccatctttcgctgacacccgcctctggggtctcaggtatgagttcatcacccaaagacccctcaacaggtcaccagactatattccaatccccatgggacccgattcctgaacgcagcctctttcgggaagggagtcagaagagcagtttccagagaccaactcacactctcgaaatgcctccttctccagcgggacccgaccttggagacggtccgagggggccctaaggtcgagacttttagggtcctgcagtggattatcgtaggcagcctttttcctgataccagaccagctctgcctgtaccattttcctctgtttaagcaggctaacagctctgacagctgggcgcccgagactgcctcgctaaagcgcatgcgctagtctcagggcgccaggcctgagctgtaaattctggctagcgtcacaatgaatgccaccgtcacctagcgacaaatccctgcggcttggcggagacagagaactttgtggaggtgcctaggcggtggactctcgcctgtcttctctgtgggatccacgggatagtcccatgatcctaggagagggcagacgtgagccagcctgaagaaacgccaagcaggagccccaggaataaaccgcaaaatccctaaggatccaaaaggatctgcaggatgcctcaggcctgcctagtcatcgtaggggtaagtctttttgaaacttgccccactgtgatttttagatacagcccacctgtgttcctcagggttgctctctcttaggtggggtttccttcagaaacatgcagcctcagaagctgccggtctgtgtgttctgtgggagtgttacaagtgttggaagtctgcgtgtgtgtgtgtgtgtatgtgcctgtaagtgtagtcgacttaaaggaatgtggctaatgcactgcagcgcttctttttttttgagtctcccaaccttatgttgtcctgtctgtgtggctctgcttggtctgcgcggctcggtgctctttatctttctgtggatcatgaatccgcagtgaattcggaggctggctgagaccggcctgggtcaaaatcacctccactgcaaaaaaaaaaaaaaaaaaaaaaaaaaaaaaagatgttcttctagaaagaacaggagcacaccacacccaagaaaggacatctcccagtgttttaccgtcttgcgtccaagtcagggaaagacactagcagttctgtccgcagggcagaatttacatcgaattcagttcccagccgagcaggtacttcccgtcgtgagggggcactcctccatcatcttcggatttcattcagggacagaaagtgtgagcagcaataaggtcagataggggagaggatacaatctgttgtggggtgaatgaggtcccacacctctacctgcaaaaaaggtgaagacagatgaaggtgcttccagctgcatcccctcagtcccttaattgcacaaccagtacacccatggcccggtgttcaggtgggaaaactccaaggtgcagggaacatttggagtgcaaactgaggccatcctgacaaactcccaatttgggggcttttatacctagagccaaatggaagtgtgatgggttgatgctgggtgggatgtggccaccgcacttgcctcttcttttgctgacttccatgttcctcatcggcctagggtttcctggggctggctcaacgtcttacacactaaatgtttcacagttcacagaggacgatcctcatgggaatccattacatgagtgttttcttctaaacgctgtcacgttttaatgactggcagctgttataattttaaaaccgtaaattcccattacattcaccaacaaggaaactcttgttctcccacttctattgaagggctgcatgattcctataggatgagtagcaggcagccatgtctggcttttgcctggtaatctaggctctgtttcatctcatctgcacgtcctttctcattgtggaggttctttcattgggctgttgctaggtgggactgcctctcgccataaatcttttggctgcgagggatttcaggcagcaaaagggacttcaggtaatcaggctgccctccaggttgtgggtcgtggtctccttttggggctgaggttgtttgcactttgcaggagggttttgggttttctgacaggaagctttgaacattggttggactccagcgcaagtcagctcgttctctcaggcaagccttgatttttgttggctttcatggggggtcaacagtgcccgtccacagcactgctgggcacccttttcaggcttgcaatcaccacagacaacctctgagacaatgtctcaacctcatctgcagccatgagaggccagttcgaagtgtgagaacactgctctaccttggacttgcatttgtcgcggtttctgcctttcccagagatcctctgcgaggcccgggatgaagtaaggcagtgaggccaagggcccggccatcttttgctgacacccgcctctggggtctcagtttagattccatcacccaaagacccctcaacaactcaccagactatattccaatccccatgggacccgattcctgcaaacagcctctttcaggaagggagtcagaagagcagtttccagcaaccaactcacactcttgaaacgcctcctcctccagcgggacccgacaacagagacgacccgagggggccctaaggtcaagacttttagggtcccgcaatgggttatggaaggcagcctttctcccgataccaggccgtctctgcctgtaccattttcttctgcttgggcaggctgacagctctgacagccgggcgccccggtccgcctcgctaatgcgcatgcgctagtttcagggcgccaggcctgagctgtgagctctggctagcatcacaatgaatgccactgttacctaatgacaaatccctgcggcttagctgggaaggagaccaccgtggaggtgcaaaggcggtggactctcgcctgtcttctccgtgggatccacaggatagtccgaggatcctaggagagggcagatgtgagcgagcctgaagaaacgtcaggcagagccccaggagtaaaccgcgaaatccctagggatccaaaaggatctgaaggatgcctcaggcctgtctagtcgttgtaggggtgagtctttttgaaacttgcccactttgatttctaggtatagccccctgttttccgcggggttgctgtctcccaggtggggcttccttcagaatcactcagcctcagaagctgccgggctgtgtgtttctgagggagtgttgcaagtgttggatgtctgcgtgtgtgtgtggctttgtgtatgtgtgtacgtgtgtgtgtgcgcgcctgtaagtggagtcggcttaaagaaatgcggctaactcactacagatttttcccccacctttttgtggcctgtctgtgtggctttgtttgggctgtgggactctgtgtcctttgtgtttccgtggttcctgaatccgcgatgaattgggaggctggctgagacccgccggggtttaagtcacctccctctgcaaagaagccactcatctagaaagaaaaggaccacaccacacccaagaacagacaactcccagtgcttcattatcctgtggccatcccagagaaagaccctagcagtcctgtccacagggctccttgaatttacctcggattgggtttccagccaagcaggtgcctcccatcgtgaggaggacactgctcccttgtattgggattacatttagggatggagagtgtgagcagcaataaggtcaggtaggggagaggatataatctggtgaggtgtggatggggtcctgcaccttcacctgcaaaaaagatgcagacagatgacacagaaggtgcttccaagtccatcctcgcattcccttcattacacaggcagtccacacgtagctcagtgcccagttgggagtactccaacgtgcagggaacagttggagcacaaacttgggccattctggtcagctcccaatttgggctttcattcctgaagccacatgagattgggatggatggatgctgggtgggatgtggcctctgcactggcctcctcttttcctcactttcacttcctttctcagggtcttggcttgttctttagcccaaagggagtggggtggacagattacctctgaaccttgggtgcctttgatttctttctttgtatttgatgtcattacgatgaacattgatgcctgctatgtgccaggactgagtcccggattcccagaggaaggaggcaccattcccctgagcctgctaatgggtcttccatccacccttctcattataaggcagagttcaggttttgagaccaggaaaacgtgaatttgactccactgggtcacctgccagctgctgacagccacttaattcctccaggcccaacatccctgtgtgtaagcacaatacacaattagggttgctgtcagccttatgcaaggggaggcttggaagtgcttggcagcagcaggtggtccacccagactgtctgggtaggcctcggtctgcttccctccaggtctgtgccaccttcactcaggctcctgcagaggcagtctgtcaccttgtgaccaggctagaaaacagcacctggcaggagggcatggggactaggcgggtccctgtctggagcccctgaaagtcggccaggcagcatctctgggatgggtggctggatgccagtgctcttgtcctggcatccctctgtttcctgcataggctcgtggtggcagacttccaggcctctccacattctctgtcctggtgatggtgggagtgtctccccctctgaaaggtgcccctggaggttgggaaatggccatgccctttgaacctcccttctggcccagggtctggctcagacagagtgcacagagtgtgtgttgaggagggtagaggagtggcagccctttacctatgagccagtgctctgcaggtctacccaagggccaacatcccaggggccaggccctaaggtgaacgtggcatcccaggtcccagcatcttctgagaagacatcatcccagtaccagggtccctgttggatagtgcctctgcccatctctcctctggctcccagcaggttcatggttgcagtggcctgtgcaggaggggtgcaggtgatggggccagggacttttgcaggaaggaactaggacattggccaaagaggctgctccctgaccccaattgtgtccctaatttactatgtgacctccacaagtcattcagcatctctggtcctgttcccccccccacaactatgtgatgggcacaacaataccacagtccctgtgactgtgttttattcaggagtcagctgtgggcctccctgacactccatccccaacaaagtccagtgtcaggagttagttggacctccacctcgatcttatattttccagcagcattttgggaaggaatatcctgaaaggtgagcctgcctgttatctcctcagagggttcaggaaaagccggccctctctatccccttttctcaccatgatcctccaggtctgttcacctaatcactaggcatgaactaattgaacatctgccaagacccaggtgagcttttgcatctagagagaactaagacacagccatggtcctgggggtctcaccctcttagatgggaggccagcaggagaggacatgtgggtcgggttcaagagtggagtaggaagttgcgagtggctagtgcccacctgggcatggtctcatgggcccttgccaggaatgtgcatgccatcctgtggcctttgtaaggcttttagcagagaagggagtgggattgagaaaaaaatccccatggccagggctgcaagaatggctaaggtccttggtggtaccatgggcatgtggcaatgaccggaggtttgagaagtagagtaggcagggtctggtggtcgaggggcatctaggggaaatcagaccgagttctagcttcccagtttgcactcatgggcagacagtggtgattttactgaggggagatgacctgaggaagagtaggatggaggaaacaccgggcctgcctgaaggtagatgccagacaaagggaggaaaagagaagcctgagaggaagcagcaggtacagatcaaggaggagaagcacaagagtgctggcccaaagggcaagaagtgtccagaagaagggggctacagaaaggtcaagttagataaaggccatagtacacttatccaatgtggccaccagaaggccagctggtcaagggtgttgctgaaggcagaggacagtgggtcaggagtgaaggtgatgatgtggatcgagagtgtagacaacaggcagaaggggagagagatggtgtggatagagggggtgtagggtcatagatggaaatatccccaagtttaggtggatgggcaggagatcattgctgagaagggatctcataagaaagtagaggtggagcagaacagagggggcaacgatgtgagggtggcagtgacacagggtcattggggagtgtgtggggacacctgtctgttgggcatcggctcatggcttagggcaggctactgggcaagcccacagacccctagaagagaggagctcctgccatgtatggcgcagttttgtcattcaccatgcactctaatttcacatactgagtacttggtatgtactggtcactgtgttggacacgggggacataaaatatggtaagacacagtcccaaaggggctaacagtactgtggcctcttactcaaaggcttgcacccagggttaagcttctaacaagttggaaggcagacataggcacctccatttgccttgagtacaaacagatgttcagagaggtttagtgactggtcaaaggtcacgctgccaggaaatggctgtgtccaggacagttgcaggtctcctgcccataaaacccacccaggccaccaggttcagtttcagccaggtggccttcagggttgaccaccctgttcgactcggcaagaagaatacaagccaaaggcaagcacgtactcattcttctgagcatcctctgtgtgcccatccctgttgtgggcatgggcggcagggaaggagacatgaattccaaatcgtgaccttgccttctgcagctgagggtgtagttggagaatttgatgtcccaggagagggatgtctcctgttccatggctgcctaggagagggcagaaagcaagccctcttgaaggagagagagaggggtaagggggaggtaagcagggacaactcttcccctccctcaaaggaggccactcaggaatcccagggaagccagacaaaagcctgtggaataaaggggcctctgagcctcctccccactgctgccatcctgactcagggatttcagggtgcagtcatcattcccacccccaaaggagaaagcccaggccggtggagcctggctgctgcaacttcttatacaagcagctctggaggccccatatctgagctggcagctccattagagggaggggtgggcattagtatggaatgccagcctagatggatggtcagtgccaggttctggggcataggaaagtccaggatcatgaccaggggtagctgatcaccaggaatgtagttgggactccatgcccgaatgctagggagactcagagctggatctgggccacaaagtgaggggacagtggctgttggtttatattgaggggaaaatggggccgacaggactaaggccctggggctgaagggcatagagctcttgctaaaatttgggaggctctgtttaaaggaaactagtgttgatagaatttccagagctgctgcctgggccaggtaagacccgcaggacccttctgtccaggttaggctcctgtaggtgcctaccctatctcctcaccttctcctagctagaggtcccctatgaggcatgaagctggtggggcagaggcccctgtcagggccttcatgtctgcctgggggctggaccacctggccggaaaaaggaagccgaggtagcagaagggcctgcctgaagatcctctgagtcttcctcctccttttctactccttggcccaggtggttgtataaattactattcacccctataaaaattgtttaactccatcacaaatatttggataatagggggatatctcaatctaattactgttagcattttggtttcttttcatttattctccttcctatgtgtgtgtcttggggagttcccataggggcatcatagagtactgattattgtgcattctgctttttcacttaccgtattcacctagtcagccagtgtcagctgctgtaccaggcactaggaaccaataaaaaagtgtgattcctacactcaggtagcttattgtccaggacagattggccatcaaatccagttaggatgtggtatgcagatatgatatcatatggttatgatatgatatggtacatcttcaaggagctgtgtcagggacatgatggagaaaccactctcccaggatcttgtcagcaagagggaaatccaggagtgcttcccagaggaggaaggtgttgacagaggtgaattctaaaggtttctacagttccttctcatgaaaccgtctggacctggtgcttttttcagtggcagatttttttatcatcagtggtaattaagtttctactcattatctagttcattaggggcactttatattttactaggaaagcattcattttctccaaatgtgtaaactctccacttttaaaatttattatgaatttatttgtggccaaacaaatgatttttctaagattttcatagacgttgaaaaaatgtatattttctatttaagggatataaggtcccatatataccaaatcaagtttttggttattcaagctgtcacttcttttgtatcctttgggggaggaggcttttactgtagttctaacagagatttagccttccactcaaattttctctataaatctcttcttttactagtttttgctttttatatttactatgatgtggggagaatgcagattttgagtgttctttataattttctctataaatctcatcttttactagattttgctttttgtatttactgtgatgctgtcgggagcatgcagatttcgagtgttctctcattatgaattgtgcccatcattacatggtgtccctctttatcccatttcagtgcttaaccttaaattccacccttctattattattatggccactctttattttactttagcttttgcactttcctggtatctcttggcattcttttattttccaccattatcattgtttaagtgtttttcttgtatatatacatcactgggtttttttgttggtggtggtgttgattgagacagggtcttgttctgttgccctggctggagtgcagtggcaacatcacagcttgcttcagcattgacctcctagtttgaggtgatcctcccacctcagcctttacagtagctgggactacaggcatgcaccattacacccagctaattttttggttttttttttttttttttttttttttggagagatggggatctcaccatattgcccagttatcactttatttttaaacccaggctgacctttgtcttttaatgggaattcatctgttcacatttcattaaacaattgatctactgtagttggttttatttcttttggcttattttacatttattggtttaccttgtgggttttttcctctggttattgatcactctggttattaatttcctttttcttcccttgttactctttccatttcattactggcatctaccccttctctggagttcctaatcaaacacatattctttagcatgtgattccatggggattttttttctcagcactgtcatctggagctccaatctgttggtctataagcttaggtctttctttctgcttctgtaaatctatttgttgtttgatttgattgttgtttttgttgttgtttattttctctcttcccctttctcctttcttttctcttcctttttcccttttctttcccttctcttctctcttctcttcagtctcttctcttcttctctcttctctccctcccctctcctccccttttctcccttctgtcatcttcttttcttttctttcacaggatctcagtctgtcacccaggctggagtgcagtagtgcaatcatagctcattgcagcctcaacctcccagactcaagtgtttctcccaactcagcctcctcagtagctgggactacaagtgcatgcaacaacacttggctaatttttgtattttttgtagagacagggtctcactatgttacccaggttagtctcaaactcctggggtcaagcgatccacccacctcagcctcccaaagtgttgggattacaggcatgagtctccatgaccagctcatttaatcttagtttgtgtgttaatcatttaaccttcatcattccccaaatctctctttaaaaataccctatagatatgtaaatcactgtaactcttatgtctcttcaacttttttatataaagtgacaactcaaaatacacttttccatttaatgttatttaatacaaaccattctattttttatgctagtatctccatttggccataaaacaatatatctagaaataaagtgtgagcttcaacagaaacaatgatctactgtttctatcaacttttgactatctataatcccttcgcttcccatctatcttcctcaaacaaattgaacttaattgtcaacttgaaatttctagagcttatgcaacttcaactcatttgtctttcccttgctttattcaactctactgccaaaattacaacctcggttaaatgcaactgtctgtgtgtctaatccttgccagcacccatgcagctgaacatgcccaaaagaacaatataacaatgattttcaacattttatatccaggccagaactctcctctgagtttcagatttatatatttaaatgcttacttaacatctccaattaactatttaatggaaatcccaaaattaatatatccacaactgtcaaattcttcacctacatcttctcccattttacaaaaattccacttttttccaatgaacatttaccgtattcatcattttgctctaatgtttcctcaaagtggtgcctaccttaatcgtattactaagtttttctaagcacttcatttttctgccctgctttgttttcctccttagaaccacctgatgcactgtatattttactaatacacagtttgtttctctcacctgctagaatataaattatataagaccagcgattttttatatcatgtttactttccaatgccataccaagatcagtacccgacactgaaacaaaggtagattattcagttttttaaaatgtgtcctgtggattactagaactgcaaaactcacttcaataagtctacgacacttaaaaaatacattcatgacaccttatcttcctggggaattacagtgatttctagtttttaaaagtaagaagacataaacttcagtttgaaaccaggactcatcatcccatagttagagctggtcttctttgtgtgctcagggactacagagaggtccggggtgttggcctcagcctcttggacaagggaagtgggcaccctatgagctcaggatccctgtccctagcctggataatggcagaatctggctcagccaggtccctggcctgcacaaagccagtggcaccaggtgaacgtgcccagctcagtgactgcctggagcaggtgtggggcagccagacccagtgggtgtgggcttgggagcctagccgcagaggatgagcaggacaagggcagtcagacagcccttagaaggcctccacccctgagctgcagaaagagatcccctcatccagctcctccccaggggcccactctggatcaacaggaaaatgtagcccctgatgtggttgtgcataactggacagatgggagacatggagctgaaggccatgtggataaccgcctgctggtatcccagttgacatcccagtaccacatatcgctgaaacccaggtcaccacatcaccaatggtcaagtcgatgtgaactgttgattgttgacgagtcccaggatcttttctgctcttgagcctgaccatgaggtagtagatgccaaagtcaggcaagcattgccaggcctgatggaggcacagctgggcctggtcggcaagagccaagccacattctaggggcttccaggatccgtgggatgagctgcttggccttgaacttttgtggaagggcagggtggggggtgtggagggagtaccaagaccacagaggctgaggcccctgacaagggcgccactgccctgggggtggttgccgaacccggtgcctgtctgctggaaggctacacctcgctggcggctgttccctgcatggtgcagcccctcctgggaagccagtggcagcccctgcagcatgcacccagctgctcctgctccgcaggtgggggtcgcttgcctttggtgagttggatgcagaactcgcagccagaggcgctaacaccagaaatgccctcacagcccttgaggttgagctgccgagggtgtggggctggtgtccactggggcgtggcctggctctcatggcaggattgcatgggttccttgaacagctcccagtgctggcctcagcccttcagggtcagcttctggggctgggagatttgaggacacaccttgacttctgtgacaaggtgtgtcacagaacacgggcttccagcccatctgtggatatctagccctccagcttctccaagctgctgagggctgcgtccaggccatccagccaggtatccacagcccatctcccctctctgagacagcctgattccataggattgcagagatgagacaccatcaacccctcctagatgcagcccacccctccagcagcagatctcactgagcagctcgcacagcggggtccaagccgcagaagtcttggggctgaaagtgcagccagagtcgcctggccctggcaccccgttaaatgaggcaccgcaggtaccagagcccgctgtgcagcagggattcgtccagcgggcgttgggccctggcgggcgagggagggtcgggcggcgtcggtcactggctcggcaggtggtcgcaggcctggattggccactgtcccagaagtgagccagcctccccggaagagcgctggagcgaagctgcccgctaggaccaccttggtcaggttgcacacctcctcgtccggttccttctagtctcaggagctggagtggggctggaggcaagtgagccccacctgcggggcaggagcagctgagtgcatgctgcaggggctgtcactggcttcccaggaggggctgaacagtgcagggaacagctgtcagcgaggtgcaggccacccttggcctttcaggagacaggcgcgggactcgggcaaccacccccagggccttggctcctccatcaggggcctcagctgctgtggccttggtgctcaggaactggagtggggccagatccgggacgccgggcactgtggaggctgtaggtggcggctgcggcccagaagcactgacgaaagcaccttgacagatcaagtcaaaatgttactgagggccgggcgcgggggcgcatgcctgtaatcccagcactttgggaggccgaggcgggcggatcacgaggtcaggagatcgagaccatcctggctaacacggtgaaaccccgtctccactaaaaatacgaaaaaattagccaggcgccatgctgggcgcctgtagtcccagctactcgggaggctgaggcaggagaatggcgtgaacccgggaggcagagtgagccgagattgtgccactgcagtctggcctgggcgaaagagcaagactccatctcaaaaaaaaaaaaaaagttattgagaaggccagttcattctctaggatgccagtggcaaacaaacatgaggatgaccagggagacgaggattttgagtgcttactttataaagtgtctataatatctgcagcagaagaatttaatggcaagttgttcagaagataagcctggaaatcttaaatgtcctatactcatttttaattatattgtatgttacatactctttggggcaagaatgatggagattatggaagtggaataagggctttccctctctgtttgcttcagaccacttctttgttaccattatcacaattggtacagttagctggatgttgtgttaaacacattaaagacatgttattggatgcgcattttaaccatatgggataggttttattaacagggtgtgaatatggctcaaacaatttccccagagtacgtaatggattagccaacactagtctgttttcctcccaagccctcttgactattattacatattcttcccatgagagaccaggagatgcctaaagaaagggatcgagggagcagaaggcgttttgtgaggaggagatatctgaatggtacttgagtataagttgctacacggttgtgtgctatgacgtctatccacaaagaacccagtttacccaataaaaccttcaaccaaccttcatatcttaatttttctttgaagtattcctctgagtgttgaagagaagtatgaaaatttgctccacagtaaactgcagagataaacagagatggctatgaaaatactacaactattattaaggaagacggctatttgccttttagtataaattgagtcaatgagatgcataaatattatttccaatatctgtgaatatttgcctaagacataatttattattattttcatttttaatttgtagatactattgtacatattgtgtacaatatgatgttttaaagtatatatattgtggaatgattaaatctagctaatgaacatatgcattgccttacatacaatttttgtgttgagaatacaacaattttaaatatttgtccaattcgcatttggaaaatacaattaaaataagcttaaaatgcctataattcacaatgcagtcataaaaattaaactgatgaaacacactaaagtcatttaaatgtatccttactcattgttcttgatgatatagtaaagcatcatcaaaatatagtagtctctattgttttagaatttgattttttagatctggtcataattatgctgtatagataaaactgtgtgttctaaacggatttgaagtcagaaacttgcactgccaagacaacactgtgtcttatcagctctgcctcaatttgcaaatcacgtaagctttctgaactccattttattcacttgggaagtgggaccaatacactaaatatttcagttaatacaaagtagaatacaaaaagaatcacactctagttccattccacatgagcacttcagctattttcctccagaaatcacctgtacaccataggaaagtaaattcatacccacctagttaacagtgtgagaatgtaagtttaaagcatgtttgactaaggaaacttaatcataataaaatggtttaatttccctgagcatgaaatattctccacaagaaatggcatgctatgtttaattggttctgggaatgattatccaatattagtcactttcatattagtgtcccctagagtggaaaataaataagatagtgattgcacttctgcatgtccatcttctgccaagacattttgctaatgtgcagtgtctgcaacttcccatttcttggctaagttcaagctttgttagtttagtgcttaggaaagcctcatgttctttcagaaattcttttgctctcattactttttgtgatattatggacaataatttgccttgggaacatgacaactgattccaacagttgccaatgttggggagggaggtgtcaaaaggtaggctttttcaatgtcaattttaacccagcagcaatttctgcagttgcaaataattctattttctttctggtcacttaagttctgtcaaattaaattagtgttcaaaactcatagcacagttttgcttttttattactacatctgcaatttgattagtgtgatatattttcatatatgaatgaatatcaattaaaggcaatgaacatttataggtaactttttcagccacagaggttagtaattttaacatgtaaaccatctgaattcatattgcaaccatatttttgtaatataagaaaatgtagattaaataagttttattagtattttaaatgtaataaaattattttctgctggctgcagtggctcacgcctgtaatcccaacaccttgagatgccaaggtgggtggatcacgtgaggtcactagttcaaaaccagccttgccaacatggcaaaatgccgtctctactaaaaatacaaaattagccatgcgtggtggcgcatgcctgtaatcccagcttcctgggaggctgaggcaggagaatagcttgaacccaggaggcagaggttgcagtgagccgagatcgtgccactgcactccagcctggtcaacaagaatgaaactcctttgtaaaagtattttcttaaaatattaaaatatagtttaatgtttcattaatatcatatgcccattaaaatgttgtattaaataactataatattactgagaataacttatgtttcagacatttcacttacattatttaaatcagacttcctaataacccacgtataaaccttggtatgaagtaactgatcctgagagatgtaaattatcttcccaaattcatgcatttatgaagtttatcaactgagttttctgacactatatgtaacatttttttctccatgccacgttggttcctggcattccaaagctcttgaagaacattgaaagaaaccaatggccttcatccgcatttcaaccaacaatgctacaatcacctttgttcacagtcctgtcttcatacaaaaagaaatgtttccattagtttccagcatcatctcacataattattattttggtttagaacactaatccactctcagaatttctcaaaaatacattaagttgctaacaatagtcagcacgttgcacaatagatctcttgaaattttactccttctctctgactgtagttgtgtatcctttgaccaacatctaccaaagtccattcccaaccacattagctgctggcaaaaaaaacattttactctctgcttgttaacttttttagattccacatatgaatgagactatgtgataattgtcttcctggcctagctcataatattctccaggttcatccatgttttcacaaacaacaggatttccttcttttctgtggctgaatgtatttcattgtatgtatatgccacattttctctacccatccccccgtcgatggacacaagttgattccatatcatgactactgtgaataatactgcaataaacatgggagtgcagatatctgttccatatactgattttatatcctttggataggtagatacccagcagtgggatcactggatcatatagtagttcaattaaaaaatttctggagaaccatagtacttagcggcctaatacttaatatttaatacatagagactgtactaatttattaggttagtgcaaaagtaattgaagtttttgccattgaatgtaatggcaaaactgcaattacttttacacgaaattaatatattcccaccaatagtgtacaagggttcccttatctccataccctgatcaacacgtttaattcttgtatttttgataataaccattataataggtgtgagatgacagcagagtggagctttagtttgcatttccataataattagtgatgttgaacattttttgcataagcctacttggccatttgtatgtcttcttttgagaaatgtctgctcagatcttttgcttatattttaatcagttcatttgccttcttgctattgagttgtttgaatttcttatatattttggatgttaattaccacaaaattcataacaatataaggtaatacatatgctaattagctagattcagtcacctcaccatgtaaatatacctcagaatatcatgtacaaaataaatacataaaattttatccttcaattaagaaattaaaataaaatgaaattttcagcatgatagacattcaaatatatgaatcacgtcatcccaacctctctttatcattttcagtagttacgggtgaaatctgagtcagggctgatgttcctagttccctactattatattcttaatacactgcagtttctcaatcatccttattaaagcagttaccaaaatttaaaaattaattttgagtgtactatgatcatctctggaaaattataatttgaagaagtgcttctatgaatgggataaaatatttcatttttttcagcattccacatttttgactcattgactcagctaaaccacataaatcttcacttttttctattttatatatcataatgcctatctttcagctgtgaaaaattatcaactatatttgtttattaactttgggaatatgaaattcagatcatgatcttctataaataaaatttagaagttttttttctaaccgaagcattcagacttgagcaaatgacaaatgtagaatattttaagtgttgacaaatatatacatataatatcaatgtttttgtgtttcgagtttctaagcaatatttgctagctgataaacttattttttatttactaataagaaataatttggattgcagaaatcaagatactctccttgcatgacattaagattaatagataaatgttatcacacctacaggcacatatgacaccaccagaactttacctaaatgattgttttccaacttatgtaattgtggttgtttataaacgtcttgtttattgttaatctttattataaacatcttgtttattattgaccttgtttataaactatctttactaattaggaaacttttttttctcttttctttttttttttcagagacaaggtctggctctgtcacccaagctggagtacagtggcaccagctccactcactgtaacctttgcctcccaagttgaagtgattcctgtgcctcagcctcccaagtagctgggactacaggcacgcaccagcacacgtggctaatttttgtatttttaatagagatagggttttgttatattactcaggctggtcttgaactcctgggctcaagtgatcaactattcctggcctcccaaagtgctgggattacaggcatgagccactgtccctagcctctgttttctttattgctttatttatctggttttgagttgggagatgatattaaacaagagttataattttccaaaaattgaaataaaaataattttaggctagaggaaaatgcaaacaatagcaacattaggatctattagcttatttgaattttgtaataaataaagatttgatataatgggaaatttaatatacttaatatgtaagtacactctcaattcttgaaggaaataataaaactgtatcaacatagaaagatataaaaaaatgctaagttgtcacaaaaaaaagaaattcacaaaaaaagaaattccaaagcagaagtcctggtatgttactattccagacaaatctgatatgagaaagcactaaagataattgaaacattaatttaataattaattaattaaaatagtacagtcctggatgtcttttttgtgctttctttaatttctttccagctatatataaatgtgtcttggtatgaatttaagtgcctgggaatgaatagtactgtcccccaggataataagttattagcaaattaataccttgcttctgttagttgtcaacatgttgcaagtaaacattgttgataggcactgtggatctactaagggtaagatatcatcctttcacaaaaggatagctattaaacctgactgtaggtaaagttaaattgcaactaaacatatgtagacatatactaagattttaaacattacacaatatttctgaccaataaaatataaactagagtctaaactgtttggttaagaatttcattgctagagtacccttacaagttctaactgaatttccaaaaatctaacattttgttctcaataaaataaaatgtgtttaataaatatgaagcaaaaaacaaaatcctaaacaaaagcaaacactgttgatcagtcaatttaacatggaatattattgctattatttttattgaccaataatttatttcctgacttttcttctcagatatggacactattgatgggagcggctggccatctggagtggcagttgccatcatgccagtagcgcttgggccgcatgggcagtgttgtcaggagcagcagcaggagcagcagtggcggtggtaggaccccgttccctgtgtccccaaggcatctgactgcgccgccgccccctaatggctgggcaggacccactgccaggtgcagaccctccatggcggcctcaatttcgcttcctaccacatctgggagcccatcagcgctggcagccgggtcttgcaggattggccccaggagcatcaggttcatttgtgcggcattagccagggcccccatgccacctgcacctcgcccatgcactactgcagggaaaacgcagagaggagtcacggccaaggctgcacactctatggagccagtggcagctggggacaagtgggagcccagccccttccaagttgccagggcaggaactccccaggcgcaactgcagctgcccaaggagggtctgcgacccaggcactcctgtgctcttgggagccaggagaaggcaggagccccaccctcccaggcacagctggagcctttcaagccacagctgcagacccaggcacctctgcactcttggggcctgggaaggcccccgtgaccacacaggctcggaagtgcctgcccccactgtctgggttctcctcgctgtcagcacctgctccaatcttcgagcaaagttgaggtcgagcacactatattgtgaccaatataaaatagatataaaaatacctcttacacttaaatccaggcattgccatttgaatgacttaagaatatgcagctaaggtgcttttaaaaatacaagctagtgattatactgaatttgtaaatcacgtaggatagtgagtcattttagaatattaattatttcagtccataaacctggatgtctttccttttttgtgttttctttaatttctttcattgatgtttgtaatttttgttatagaaatcatttacttcctcggttaagtttatttctaagtacatttttgtagctattgtaaaagaaatagcttccttaattttttttctgctagtttactatcaacatatagaaatgctactgttttttgtatgttgattttatatcctgcagctttattaaattcatttatcactctaagaagttttaggtagagaccttagtttcttccgtgtatgagatcacattgtctgcaaacaaggataatttgactgtctcctttccaattcagatgccctttatttctttctctaacctaattgccctggctaagactttcactatgtgaaatatgattggtgaaagtgggcctccttttcttgctccagttttcatggtaacatttttcaccttttccacgttcagtatgatcttagctgtagggttgtctttacgcccttttgtgttgaggcatatgttttccacactaaattgtttagaggcttttgtcatgtaagaacgtttaattttgccaaatgctttcattgtgtttattgatttaatcatatggttttcaatatatatccaaaggaaagaaaatcaatatatcaaagccttacctgcacccccatgtttattacagcactattcacaatagccaagatatggaatcaacataagtgtccatcaacagatgaatggataaagaaaatgtgacatacatatataatggaatactattaagttataataaagaacaaaatcctgtcatttgtggcaacatgaatgcaactggagggcattatcttaggtgaaataagcctggcatagaaaaataaacaccacaggccaggcacggtggctcacgcctgtaatcccagcactttgggaggccgagacaggcggatcacgaggccaggagatcgacaccatcctggctaacacggtgaaaccccgtctctactaaaaatacaaaaaaaaattagccgggcgaggtggcgggcacctgtagtcccagctactccagaggctcagacaggagaatggcgtgaacccgagaggtggagcttacagtgagccaagatagcgccactgcagtccggcctgggcgaaagagcgagactccgtctcagaaaaaaaaaaaaaaaaaaaagagaaagaaacaccacataactacatgttctcatttacgtatggaagcttagatagtagagtattggttaccatatacgggaaagagaaaggggagtatcagaaaaatttggttaacacatacaaaattacagctggagagaaggaataagttatagttctctacagcactgcagggtgactgtagttaaagggaatttattgtgtgttttcaaataactagaagaaaagatttttagtattctcctgcaaagaaataataaatgatttaggtaatggatatgctaatgactctgacttgatcattacacattgcataaatatatcaaaatatcactctgtaacccataaacctgtacaattattacatgccaattaaaaataattttaaaagagaaaaaatgaaataaaagtaaaggtacagaatttaactactttttcttctatgaaaccaggaagagtgaatttattagttttctaaaataaaaaaaaatcaaaatgaccaaaaaagagcaatatccaagaaaaacaacacttagtaagaatacttagaaaacttgggcactgtatcaccctgttcctagataccaatttacagatgaccacttaaatagaagtttattccagttaattcatttataatcccagagttcaaaattatgttgtacctacaataaatgagataacacgtttaaattatatggtactctgcctaacacaggttaataactcaatacaggttagcaataagcttttagtgtagtagtcatagtactatttctcacattgcaattttcttcattcagagacatgaatacaactttcttcatgactcctttttcatcaagatacctcttcaaattattctatttctttcattcagtatattagctgtgtatatcgatactgcattttttttttttctgagatggaatctcattctgtcacccaggctggagtgcagtggcatgatctcggttcactgcaacctccaactaccaggttcaagcaattctcctgcctcagctccccaggcagctaggaccacaggtgcacaccaccatgcctcgctaatttttgtatttttagtagagtcagggtttcaccatgttgtccaagctggtctcaaactcctgatctcaggtgatccacccaccttggcctcccaaagtgctgggattacaggcgtaagccaccgcgcccagcctaatattgcattcttggattttgaacactgaatatctttttgaaaggttacacctctttaccaattggtgctttggaaattattttccttcaagtgttctaagagtctaatgaagaatgaaggtcatgttttatcacttttgtccttaaagatttcagacatgctgaggctgagcttggtggctcacacctgtaattccagcactttgggaggccgaggtgggcagatcacgaggtcagcagttgaagaccatcctagctaacacggtgaaaccccgtctctacaaaaaccacaaaaaaagtagccggtcttggtggcgggcgcctgtaatccagctacttgggaggctgaggcaggagaatggctgaacccaggaggcagaacttgcagtgagctgagatcgcgccactgcactccagcctgggtgacagagccagactccgtctcaaaaaaaaaaaaaaaaaaaaaaaaagatttcagacatgctgaaactgaatgaagtatcattcgctaccagttagattagttctttctagttgtaggagtggatacatctttaatggtatattttgggttattgccttatttttgatgccatattctgtaaataattttttaaacctggcaaaactcggtcagcatagatttgtcaactttggtgttatattgtgtttgcttttaaaaactgcttttgaggccgggcatggtggctcttgcctgtaatcccagcactttgggaggccaaggtgggcggattacctgagatcaggagttcaagactagcctggccaacatggcgaaaccccatttctactaaaaacacaaaattagccaggcatgttgatgcatgcttgtagtcctagctactcgggaggctgaggcaagagaatcgcctgaatcagggaggcaaaggtagcaaccattgcactccatcctaggtgataagagcgaaactctgtctcaaaaaaaaaaaactgcttttgaatagagttgtaaatacaattttttatgaaaaaagaaattatcaagtgcataagttcataatacaaaaacaaataaaattcgaggcacaagttagtactaaaaaaattatgttcatttttccctaatacaacatgttttttcccttcatgaacaatttgtgttttactgagaagactcattatttatggcagaagttagactacagatgaatatgtactttaaacactctcagtagctttcttaattttacatatgctgctttatgcttctgtttattttcatttttccaatgtccatattctagtaaatttgaatattttaattcaagtttattgaatttaatatttaatattgcttgtataatttagtatttttaagactcaaaaaggtttatgaaaaaaagaaaaagagatcaacgtgttgctaatcatttaaagattattttaaaatctttgacctttatatgttaatgaataaaatgttagtagctattagtataaaataatttatgtcttttggacttagcatccagcatttctttttttaataaataaataattattctcctgtaatatattatgtttatctgggttttgaaaaatgatgtttcctaatatgagaaagccatttacatgtttaaatctacaaaggcaaatgaaatggtactaaattatttacataataacgtttagatggtgacccttataacattatttgtatacttcatacagagttgggaatatgcaatcctagaatatttctgggggcaaacccttcagtttgatgaacaaaacaagacttttaaataaaattaaacttttaaattacccaggttatggggccttttaattcaatggatatggagcataatgaattatccccttttcattgggtaataagttctcattcttaacttataatactcaaaataccctttaatttttaatttgtgattaaccatatcattatccctaggtattttagcttctatcttgaattctataataattttgaaacaggagaaagtattctttattaccatatgtgttaaacatcatggttttcaaatttaactgcaaatgtgtctttttcattgcttcctgatgacgcccttcaccctatccatattgtcactatcaagtggtaattacttttcaggttcacatatttgtttttttggaaaatcttctctgtgtcttataaagaatatgattgtaggcattcaaaaaccagtgaaatacacataattagcctgtggcctaactcatttctttaagaaactacactaattttacccacatactgatatttttattgccgcattatttctggagaaaataaatactgctaacatgatgttggtaagagagtaaaaaagtcttttctcgaaaagtgctcattgtagtattaacatatagtgtcaatttctttataaattcctcatacacattttattcttagagaaataaaaatgctaaaagtgaaatgactttgtttattctgcatattataagccacccatcttggtaatttagggtctttatagttagggtaagttgtgtcataccgaggtaacaaaacaaaaggtattttgtctcttttgggcctttcattattcagttatactgtcactttggctttttttgtaggtcaacctattgacctcagtattctgaaataatatgtttactatcttttgatcagcatttaaaatattagatttattgttactcttctgcctttattgggctggatgaataattgtttctctcactccacaaaagccaagttgcagagaaaaacacatagacattcagttgcaaagcaaagaaacgactattttctgcaattttaaagtgtacattgaatgaattaaaccatctttttattttcttttttgctcacttgcaaatattaacaacatcaagtgtattattgtaatgttatctaggtaaaaatctcaacaagttttcataattaccatttttaaatatataaataggggacctaactttaatttttaatgtctgaggccatgtctgttatttcactctttaaactcagttcgtaatgcagacacttagtaaatactcaaaaaatatgtgctgaataaaaaaggttaaatatgtaatatgtacaaaatctactggaaaaaatgcaccaacaattttatttggtataccagtttattgtagaatctttattgcctttaaataataatatacttttccagtgtctacaatgacttgtaatatttgtacacatataaaataatatttccaaaaatgtaattcagtaaggaaatataccttctaaattctagatttataatttaggggttaaattataaaatcattaaataaaatacaaatgacatatagtcaaagatccccttggaaaaaaattaagtggcctctaaagtgatgtattcatatatataattttacaatcaccctcagtttgctgttcctctggcattagaacagattgttgttgtttatttgctttaacatcaaaggtaaatgtttttgttcaaggacatatgtaaaaataaatgcatatggtttacaatagcatcatatttagtgataagcacataggacatgagaccatccgaaataaatgcagaaccaaatctctcatgcatatgcactcaaccactcatgtttattgataaaatgctaagtggaaaaacctgaattttgtaaatttgtctcctttgcctttttaaatatacacacaatcaaactctttgtgacttagtaatgaataagtaatactccattgcatatgtaataaaatgtgtggcataaaatcaatattaggtataaaaaatctatggcaataaggttagaaggaatgtgccatagcagcgattatctcatagccaaaaatataggtatttttagtctctgatttttttcattgtctacactttctacgaataacacagataacttttgtaacattttattctaaatactttaacatgaaagatacatttaaaaatactcattccatatacacactgatttttaaaatatttattatgatttctcatggagtttaggaatattcaaaatctactaaaagttatcatgttttatgatagctctcacttgctttaaaaaaaaattcttgataatttacaagtacgcagtgggtatccacctggggcctagatatcctcttggggactgatgtcatcctggagcctgatgtccacctgggactggctatccacctgtggccagatatctacctatggccgaatatccatttgggacctgaagtccacctctggccgaggtgtccatctgggacgtgatgtccacccgacacctaggtatcaacttggggcttgatgtctacctgtcctcagactgtgggcccctgagggtcagggaccacgtggacattttcagtaccatatgctgggcccaccagggcacctggcacacaggactaatgctaagggcagagttgctgagtgaataaatgggaggatgtcaaatgccccttcctgcttctggccatctcataatgtggagatcattcataagaacaggaactgcatgacctcagcatgactctcccctggacccagatgcatgagaacagcacagtgggcaccaggaacacagaacactgtcctcccacccaccctgtagccagcatcagcactgcagcctcaggcaggagcatcacagaacaaaacagggaactgcatttaggattcctcaagtcagtggctctccaggttcccaggaggcagacgagcaggatctgcaggctccaagggcagtgagaaggacctcagcagtctctcttgtcccctctttgcctccagttcctggggtgtaaagttcactctcgaggtgtcctcaccacagccagggcagcaatttcccccaacttccaaatgaagttcgatcgtgttccgggacttttgacacagggtccagtgcctgggcacattctgtcctatcccaaatcctcatccacccaaactaccaagcctctgtctgctccgaaggacccccagagtgaatagctttttccaagtgtctcagcacacacggggtcattcataaaaaaccaaggtcaacaaacactatccaagcatgtggaaccctgtggtttcatgctctaagcacctcacattatatacaggagaaaacggaggcttcgtctcctgtagcccctgtctacactagggcaggtgggatggtcgtagttccaggtgcccacagaggtggactgcaggaccccagttctgtcctttcaaggctgtgctgggcaaggccctggcccaggcagaaccctgggaagcttgcggattctcctgcccatcctctaggcccttgtctgagcctttctctaaactcagcacattgaatagggcttgctggctacatgtaggtcaagggtgtaacccccatatctctaattcctcacagagttcttgctatattctccgacccaccctgttctcagaccttcagactcagagaggtgatggactactgcctggtaactctatctggatatctaagagcaaaccctacatagcaaattgtgccaacactctatatatccaccacccacaaacccatcccaatcataatgcccaaacagaaactaaatacttggattagtcccatatgcagaaaaaggcaaattataaacaaaatattgttattgggttagtggaaaattattgctgtttttgacattatttttaatggcaaaaaccgcaataacttttacaccaacccaataggagagtgtgaaatgaacaggtctagtttgttgtgcttttctattttctgtttgttcatatttgttgctttctgtgtatctttgagagtttggaggaatttgtgaaaggaaccaggataaacattttttcctgctatttgaagaccacgttttttatctatgttacatctctattaatagctttttcaaaattctgtttcatctgcataccttatgttcttaattagtgttgctactaatatcaaaaattattttctcattttaatattttgtcttctgttgtttcttagtttgtttcttaaatttgttgtgctttttgtttacttgtatgctttttctaggttttcagaaggatgatttattagatttttagttttttccaaaaaatgtacttaaatttagaaatatacctccaatttctgttttaaatgcattctcaaaaacttacatatctaaaggtatttatcattatactacattgttttcataattcacctattgttttctctctaacttcaagattacttaataatgggcttagtgatttccaaatatctgaaaattttaattgttgctggctttgaggaatataatatgatattgatgatttagaatacattgattactcctttgttgtctagttcatgacctacatttgaaaacatgacaaaatttatatttctttgttgaatgtacatttgtatacttttagataaagttattgaccatgttttttatatccttttcagcttttttacttttgattttcaatattattgtactggcttaccaaagaactagttaaaattaattttctacctatttccctatcccatttgtctaaattaaaattacaaaattatacttttaattatacttatgttacagattttcatattttttgattaatgtttctttatcactgtttcttataaagtcatttttggtatcctgtgattggccctttaagtggtgatgaatagaaataataaagcaactgaagcaaggtgatatgaaaaaatgagaagacagaaacaaatcaatgtgtccgtttatgtgaagtttaactgtataagagcaataacaaaaaaaacccagaaagttgtttttcaaaactattcatagaaactgagattacacagagagagagagagagagagagagagagagagagagagagagacaggccccaggtaaagaccaggctcctcatagaactctggccccaggtggacactgaactccaggtgtacattaggcccccagttgatgctcaggccccaggaaggtaaccaggcttatgatggatatatggctccaggtggatacccagaatccagtgagaaatcagggacaagtgggcaccaggcctcagagggatacctacgaccctagtgacctcaggccccagttggacagtaggccacaggtgaactccagtcttcaggtggacatcaggccccaggggaaatacaggtcttaggtttactcctaagacacaggtggacacaggtcttaggtttacccctaggacccaggtggacaacaggccctgggtggccactggccccaagtatccagtttcctaagagctagggtgggcaaccccactgggcactgtggccaggcctgccatgtctccttgttcagctgccacattctgatggggagggcgggaggtgtcgagagaccacaatctaagttcttattacctgattttatttcacctccactgagtgctcactctcctctcacctaacggatttactctcatctgcaggtggtttaagtgtgaaggtttactgaagatttaaagagtgttatcacagttgggatgatttaaactaacagtacacgttgcattttaagaaaataattaatcctcagaggagatatgggttatggagccatgacaaattttcagcattacttcccttacttgttgtttccaaataaaagatttttgattccccattgatgttggatgagaacgctgagtgtgcaagcaaaatatcattttttaactaagggcccaatagtgtcttaaatatgcagagctgagtctgcaggtggagagtgatgggtttgttcaaaacgtggtatagagtggccttgggtctcacctgcctgcccttccatcctgtgccctcccagtgaggcacccaagccccaccttagggcacaccccttcacagggccacataggccccagtcctcacctatgtggtcatctccaaatggcacagcaacaccttctgtccaggcccaggccagggtcccagtatctccaggggggcctggcatccaggcatctgttgagaactggcccaatgttggggtctgggctagcctgtgggacctggatgttggggggcagctgcatgaggactcatgcctggctttatgtgtagcaccaggaaaggcactttaatcgtattcatttattgctcacaaaacctctgaggtgggtgccttccccacgtcacagatgggaatgacaagaaataataaggttaaagagcatgctcatggttgaaacctggtcaggaactcagaactggagtctatagacccctacctgtgacctctgtggccggaggaccctctctcaccgggtttgtgtttgcagcatgtcctgtccttccctaagggtctcaggttctgaggcatggtgagggctgctggagcccatcactgagctgcagaaggagatactaacgctggccatgccaccctccaggcaggcacaactggagttgaaaatcgagatggggcagggctgccaggaacagagggaggcaggtggagaataactcaccagggaggggtttccctgctacagctttccagggccatttccactttctgggtggcattttggggcagctcacacagtacacccacatagccagtccccagggtcacaatccccagatgttgttcatcttggtgacaggccctgtgcttctccaggaccgtttgtgtatgggcccttcccaggtaagcgtgatacgtcctggctgtcctcagtccagggcactgccagcattttcctttctggtcagggtcaaagctttgttgaccatctccaggatacgatggccagctggcccttggagagccagtcactccaggtgacacggtttggtactggacgtccgcggtcccctctcccacgccgccccatactgggccccgtatccagccgccaccgctgctgcagcaagaaccgccccactgcctccgcgcagctgccattgtttaaagggacctcagcctgacttccaggagctacgcaagacttggccaagtcaatgcgcatgcgcaaggagagagccgcttctccccatcacagcgattcccagggttgtcgtagaaaccactccctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggagggtgttcgggtgagtctccccaaaagtcgtgcccccgtgatctggaggacaggtctgcctgtgtgtccgtgggctgctctctcacccgagtgtcgttcgcgtggagagcagaaccctgcagcctcaagggttgcctgccggctgaggtgggggtgcttccatgacaccgctgtatgactgtgtgcgtgtgtgtgtgtgtgtgtgtgtgtgtgtgtcccattctcttctctctcgctatcactctctatttctttccctctctctgtcggtttgtatgtgtgtgtgtgtgtgcccttgtgcgtgtgtgtgtttggacgaatgtgccccgtgcaccagaaagcaatttcttgcatgtcagtcggtctttggtgagcctttttcggcgtctctccctgggtcctgtggccagttgtccatcgttttcctgtcggttccactttgggtttgtgaaggcctcgacaacgtgaggagatgcgtcgatccccgagcaattgaaatctcatccctatcctgagtggcctcttttctaggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccaggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtggacatccttgtcatgattgtgtctctctccaaacctgtttctgcttgattgggcaggtttgatgaccctggagctcttagctttcatatgtgtctcagacagggaagctaccttggtctccatgtttcacctcatgggtagtggattgcctagaagcaatggtaagcgaccatgactggccttttcttctatgacgggcgcggtgtcgcatttcctctgcatctcctgtctcattcttgagggatgtcctctcctctgctcctgggtggactgactccctgaatcttttggccccctcctggattccaggtgttctttgattttgcttggcattgatggaaaggtcacttgtaccccccttcagttgggcacatgcctggacaccattgcttgtttcgccatcaccccatatgccctcggtgacacacatccacaccatctgctctgggatacaccagtgccacgcgtggtcgccttggttccacctcggaatcgccccgtccctgtttgcatgtgtcctggaaagcagtatcagcttgcaggagccccagggcttttagaagcggggcaggccactgctcttccaaaggaggagggaggcagagggctcatgggtcagtgaattttcagctgacactacgtcttgaggcccatgggaacattctgtgctgcagcgaggccctgcctggtcagcggatgtggtgagcccatcctttttcacctggaggggtccaaggtcggatccgaagaggcgtcctgagaccccagcaggcgcccttgagctctctcttcactggtggaagtcggctcaaggaggtcctgaagacaggactcctgagggtttggccctaggtcaccggcggacccctctcctacgctgccgctactggatcccggatccagccgcggccgaggttacagcaggagcgcgcctgcagcggcgcagcagccattgtttcaaggggacgcagcctgattgccaggagtggagcgcgagtcggccccaccaatgcgcatgcgcgaggcgccagaggattctgccatcagtgattcccatggttatcttagaaaccagtccccgaggcttggcaaagcaggagccctccgtggcagtgcttgggcgtcggggctccgaggcccaggcctgacctctccaggggtcgacaggaacgtctccggatgccaggagtctcaaagggcggaccagtatgacgaaaccacaggcagagtcccggggaagcagcgcggcatcccagcctcaggcctgcccggacggtgttcgggtgagtctccccaaaagtcgtgccccccgtgatctcgaggacaggtcggcctgcgtgtcgctgggctgctttctcacccgagggtcgttgtcgtcgagagcagaaccgcacagcctcaggagttgcgtgggggtgtgtgcttctgtgccactgctgtatgactctgtgtgtgtgtgtgtgtgtgtgtgtgtgtgtgtctcccattcgctcttctctctctgtctctcactctctgtgtgtttctttccctctctctgtcagtttgtgtgtgtgtgtgcacctgtgcttgtgtctttggacgaatgtgccctgtgcgccaaaaagcgatttctcgcatgtcggcctgattttggtgagcctctttctgcatcgctgcctggctcatgtggccggctgtcgatcgttttcaccgccgcggatccgctttgggtgtgtgaaggcctcgacggcgtgaggagatgcgtcagtcccggaacaactgaaatctcatctccatcctgagcggcctcttttctaggatcaagatgaccacactgaagccaaggacaaaatccttacaggagctcactgtcctgcaggagaggagcggacccacgtcagggaagatggtcgtatcttttcacggctcttctctgagaaatgaagccacaccaggatacaatcttgaagaggaagccgggaatgggagatggcagcaatccttgtccctgggatgctggcctctccggacaagtcacccgtttgacacccctccccttatgcctgtggcagtggcatggtgctgtatcctccctgggctctggcctctgctctgtcctccctcttgctctgtctcccctgtttctgagtggcctagatgcctcttggtctggctgaatgtctccaacaaagatcacttcccagtccatcagggagacagttggtggacatccctgtcatgattgtttctctctcccaacctgtttctgcttgattgggctggttggatgaccctggagagcttgagttccatagttgtctcagacaggcaagctaccttggtctccatgtttcatctcatcggtgggtggattgcctagaatgagcagtaggccactgtgatgggcctagtcttctaagacaggtggtgtcacatttcctctgcacttcctgtctcattcttgagaaatattctctcctctgctcccgggtggactgactccctgaatcttttagccccctcctggatcctggtgttctttgattttccttgacattgatggaaaggtcacttgtgccccccttccatctggcacatgcctgaacaccatcttgtgtttcgccattgccccatatgcctttggtaacaaacattcacaccatctgctctgggatatgccagtgccatgcgtgttggcatttgctccactttggaatcgcccttgtccctgtttgcatgtgtcctggaaagaggtatcagcttgcaagggccccagagcttttacaagtggggcaggtgactgctctttcaaaggaggagggaggaagagggctcttgggtcagtgatttttctgctgacaccatggcttgaggcccatgtgatcattctgtcctgcaacgaggcccttcctttctcagcagatgtggtgagcctatccttcttcacccagaggggtccaaaatcggatctgaagaggggtcttgagataccagcaggtaccctgaagctctccctccaccggtggaagtcagctcaaggaagtctttaagacaggactcctcggagtttggccctgggacccccgcagccccttctcccctgccgccccctactggaacctgcatcccgccattgctgtggctgcagcaggattccccctgccaccgcgcagtcgccattgtttaaaggggccacagcctgacttccaggagcgaagcacgagtcggcccagcaaatgcctatccgcgaggctctagctgattttcccatcacattgatttccatggttgtcttagaatccagtccctgaggcttggcaaagcaggagttctccgtggccctgcttcgttgtcagggctctgagcctccagcctgactcgcaagggttttaatacccttctcatcctcatctgcctctttgcgaggatcaagacgaccacaacccagccaaggacaaaggcctcacaggtgctcattgtccacccgcaggagggtgctcacagaccttcaagaagacggttttcactcctctcacactttgccctcattgagaaatctagccacagctagacacagggacagagaaggaagccagcaacgggatgcggcaagcatttctgtcacccaaacgctggccttcctggccaagtcacccgtttggcactttttcccagatgcccgtgatggtggcattgtgccatatcctgcctgggtgctggcctctgctctgtccttcctattgctctgtctgcccagtttcttggaatcctagaggcttcttagtgtggctcaacgtcttcaacaaagaacacttcccagtccatcagggagaaatttctttggggtccatttcatgattgcttccctctccaaacctatttctggatgattgggcaggtgtgatgatcctggagctctgggcttccatacctgtcttggacagggaagctcccttggtctccatgtccgaggtgatggctgcgttgtcggtccaggaagagtgggaggcgaccccaccgtggctgacctttgctttctaggaaaggcggtgttgcatcccacctgtgcttcctctctcattcttgagggccatccggttgctctgctcctggggaaagtgccttcaagcagtgaatcttttggttgccacagatgtgagggagccaaagggactgggttttgctggttttaggagaggtggcgtcagtggtacctacccggtggcagggtgtcgctgtggtggtttgtcgaaacctctcagcccctctggcaggcatccctgaatgtggcttggactcgggcacaggccctgtctggcaggttttcaggtgtgcttggcttttcctcagctttgtgtgggaggtcccagaagcccacggacgcacgcctggacgtcactgtcagtctcggcatcgccccatacggcctcagagacacacgctcactccatctgctcttgaaagacgtcagtaccacgtgtagtcacattggctccatctcagactcgcctctctctttgcatatgtcgcagaaagcagtttcgggatgccagagccctgggccttggagataaaggcaggccactgctccacccaggaaggagggaggcagtaggctcatgggtcagtgcattttcagccgacagtacgccttgtggctcttgggatctttctgtgccccagcgagacccttcccacctcactacattgtaaccccattcctgatcaccctatcagatccataatcagatccgaagaggagtccagaatgcccagccggcaccctgaagctccttctccaccgggaactgaagcagaagaccagaaaaccaatcaagaaggtcctgacgacaggactcctatgggtccaaccctgggtctcctgcagaccccctcctagtactcttcccacccgccaccttggactgcgccgctgcgccagtccccgcagcccgtcgtgtcgccgccattttttaaagggtccgcagcctgactctccggagcaaggggggagttggcctcgccagtgcgcatgcacgaggccagagtctctgctttggtaacagtgaccgcctctgttgcccagaagtgggtccctgagacttggcgaagtaggagccctgtgtgatagtgtgtcagagtcggggctgagaccagtcctggccagggtgttaacaggatggtctccggagatcgggattctcggagggtcgaccaccaggaagaaacctcaggagcaagaaagctcaggcagattgctggggaggcagtgcgagatcccaaactcaggccaggatttgcggagggtcaatgaggcccctctcccaatcttcacttcaccagccaccgccccagtccccgcagccgccgctctgccgtcatttattttattattatttttttttaatagtcggagtctcattctgtcacccagtctggactgcagtggcgggatctcagctcactgcaaactctgccgcctgggttcaagtgattctcttgcctccgcctcacgagaacctgggattagagggattaatcagaatcggggctaagaccagtcctggccagggcatcaacaggatggtctctggaggccgggattcacggagggtcttccaagaggaagaaaccgcgggcggaaggccgaagaagcagcgcgggatccctgcctcaggcctgcacggacggtgtgccagtgagtctcttcaaaaaaggagagatttgcttgtgtgcccatgggctgctctctcaccggtgggtcgtggttgcggagagtagaacccggaaaattcaggggttgcctgggggtaggtgttaccgtgccactgccctatgtctttgtgcgtttgtgtgtgtgcgtaggtctctctcttatttctctctctctcctctctcgctcttttgctctgtgtccgtctgtgtgtgcgtgtgtgtgtctgttgggacacatgtgccctgtgctccagagggcggtatcttgtacatcggcctttcttctggtcagcctctctcggcgtctctgcctggggcgtgtggccggttgtcagtcatttttccggtggctccaatttgggtttgtgaaggtctggcgaggtggggagctgcgtctctctcataaggatttaaatcaccttcccaccctgagaggcctcttttctaggattaaggcctccagcccccagccaaggataaaagcctcaccagagaggtcattgtctacctgcaggagctgtgtagagagacctggaaaaagatggttctcattcgtctctctctttcatctccttgagaaatctagccacagagtaacacaggttttcagaggatgggaatgggatgtggcaaggatctgtgagtgtgcaggctgtgtttcacatatcattaaacatagtctaatgagtgttctgcagatagctgacatttaagtttgttttattgaatcaaggaaaagaaaaaatgctgagaaaaaatgacacaacttccctgccacccatctgagtgttacaaatttaatagtaattttaatttatcttctcatgtaaaggtccttggcagtgatacctaatttcctaagatagccttgctttatttcgtatacttaagatgtcatgcatatcagagtatctggaaattcttcccaatgcccttgacatatgtgattaatcacattcccaaaataacataccaaaacaaacaacagaaaattatttgttacttaattccttcaaatttgtttatttaacttggggttccttcatgcacgaaacatttcatgtgtgtgtggcactcttctggtcacagatttcatcttaaataacctaagtattgaaatgcttgtgccctttgattaatttttactacataaatactttgattaaaagctacattgaggctgggtgcagtggctcacacttgtaatcccagctctttgggaggctgaggccagcagatcatgagatcaggagatcaagaccatccaggccaagatggtgaaaccccgtctcttcaaaaatacaaagaattagccaggggaggccaggcgctggctcatgcctgtaaccccacactttgggaggctgaggtgggtggatcacctaaggccaggagttcgagaccagtctgcccaacatggcgaaaccctgtttctactaaaaatacaaaaaattagctgggtgtggtggcaggcgcctgtaatcccagctacccaggaagctgaagcaggagaattgcttgaacccaggatgcagaggttgcagtgagctgagatcacaccactgcactccagcctgggcgacaagagtgaaactctgtcccaacaaaaaaggaagaaagaaagaaagaaagagagagagagagagagagagagagagaaagaaagaaagaaagaaagaaagaaagaaagaaagaaagagaaaccttgtgtatactaaaaatacaaaaattagaccctgaaggtcacatctgaatgagaaagacattatttggctcaaattgactgacactaaggaatagtgcagactggacaagtgaggtgacttacacctataatcccagcactttcggaggctgaagctggtggatctcctgaggtcaggagttcgacctcagcctagccaaaatggcaaaactctgtctctactaagacaaaaattagccgggcgtggtggtgcacatctgtaatcccagcttctcaggaggctgaggtgggaaaatcacttgaacctcgaaggcagaggttgtagtgagccaagatcgtgccaccgcactccagcctgggtgacagaatgagactccatctcagaaaaaaaaaaagtatgtaaatcactaatgtatcaaagaaaacagtcattcatgtattgcaaataaatactcaaccaagacaaaaaggcacgtcacatcttatgggaaaagacggaaatgacggtgagaggaaaactgtgacccttgaatgtaagacagaaaaaaatcagggcacgatgttaaggaattggaaataattctccatattaaaggaatacaagagacagaaagagaggagagagagacacgatagtcacagactgcaggggtgtggggtagatgggaatcaaggaggcagagagagcagtgggaatgtacataaaatcaccctccagagctgtgctgtccaataagtctgctgaacacttgaaagatggctagtccaacctgagaaatgctgtaagtggaaaacgcatttaaaaaaattctgaatacttagaatgggccagtgtgggggttcatacatgtaatcccagcattttggaaggccaaggcgggaggactgcttgagccaggagtttgagaccagtctgggcaacagagcaagacctcatctcttcagaaaaaaaaaaaaaaaataggccaagtgcagcggctcacacctgtaatcccagaactttgggaggccaagataggtggatcacttgagctctggagttcgagaccaacctggacaacatgccaaacccctgtcttaacaaggttttttgtattttaaacatggaagaaccccatttctactaaaaatacagaagcagccaagtgtggtgggccatgactgtaatcccaactactcaggaggctgaggcaggataatcctttgaacctgggaggtggaggttgcagtgagccgagatcgcaccactgcactccagcctggcaacacagtgagactctgtctcaaaatatatatatatacacacacacacaattttggagcgaagtttcaaaatcaatcagtaagcactacccaccaggtttatccttacataaagtgcccgctctgccttgaaaatcttatgctaagtggaagaagcccgtcatgaaatatcacatgtaattccatttaaataaaatgtccaaaatacatgaatgcgtagagacagaatgtagatttgtggtggcccagggttaggggagttgggggaaatggagggatatggggtttactttggggtaatgaaaatgagctaaaatttattgtggtgatgtttgcacaactgtgtaaatatactgaaatcattgaattttacactttaaatgggtggcttctgtgatatgttaatatttttcaataaaacttcaagaaaaagagtacctgtgtgcctccagagtccacatttttacacttgatgaagaaatcaagatattgtttcttcttcttctttatttttatttattttattttattttttgagacagagtctccctctcttgctcaggctggagcgcagtggcgtgatttccgctcactgcaacctcccagctaatttttgtatttctagtagagacggtgtttcactgtgttggctaggctggtctcgaacttctgacctcaaatgagtccaccatcttggcctcccaaagtgctgggattgcaggcatgagccactgcacctggctcaagatttagtttccattgtttcagatgccctaggaccattttattctactttaatttctgatgcatcatcgcagtggacattttacattagctcccaaagtattttactctgtttaagattttatcagctgggcacagtggctcacacctataatcacaacactttgggaggccaaggtgggaggatcagttgagcccaggaattcaagaccagtctctgcaacatagtgagatgcccatctctaaaaaaaaaaaaaaaatgtttaattaggtgggcgtattgttgcatgactatggtcccaaccagtaggtaggctgaagtgggaggatcacttgagcccaggaggtcgaggctgcagtggccatgattacaccactccattccagcaaaaatatttttaattacatttttttaagaaaacaaaatatacacttagtgacttgatacaaatgaatgacttttataatctacagaaaccaaaaaaataacaataatataaacccacagccattcttcttatgtgagtctctggtgtctctgagttgtaagaattgtgaattatgattaataacaaatatgcatgacaaggactcaataagggataggcattgataaactgcaaacaacacttactggagtaatgtctttaaagttgtacaagaagaagaaaaggcattgaaaaactgcgttggctaacaaaatactgaagttcacctaagtccattaatcagcacacgcacacacacacacacacacacacacacacaatggatgtgtaaaatggtcaacacagtctcccatgaatgtatcattttattaataggtctgtgagggtaagagatgaggttctatagatcctggaatcagggatggggaatctgtgaggtccctgaagtgatagatgagggtctgtagattggtgatgggtggtcttttggatactgatgaggtccacagaatcaattcttgtggatatgtagggtcagtgatgagggaatctggtgtcagtgatgggatgtgtgtggaatcaatgagaaagtgtggaatcaatctgtgaaggccagatttgtggtgtcatctctcaggctgacacatcctgatctgtgtgtcagtggtggaaattctatggggtcagagtgtgacagtcagatccctgacactgggtgttctgggtccggccaagtgcacagattcccttacctggtcctggctggagaggcccttctcacggactcctcacgtgaaaagtgggttgtcggcggtttttgcttttgctttgttttgtggtgggggtgggtgggttggctttttctttagggtttggttttgcctcttagagaccacagacacatgcagctcttaggaagaaatttttgtcttggcgatcgctaggtcctttggaccaagccatttaatgggaacgaagctgaccattcccttagagcagttcagatctagacggtcgctttaaggtgtccacaagggggactgcaagtggattgtggctttgagtggcaggtgggcgggaagaaacaactaagaaagacacacaagctgtcctcaggctgaatctatcacagctggaagaacagcctccctaacccatcaggcgccaatgggaggtgcctctgggctgtgagaggctggcggaggcgggacttccagacccagaaagtctgggcacagaagcctattactgtcagacgctgaggcgttgccgtgggaaccaagggcctttcgggtcagatcagagcctttctcagacaattctttccgtaactgacgagctcctgtccagcgcacgcctctatgaatgcttagtgtgccgtctcgggcagagtcttatttggtctgagagccacttgtttcttaaatccctgcgctaatcttgccgtctgctcctacgtagcccaggcatttgctgcatgctggtcctttctttcctgacaggggagctgcctctccagcttcctgggaggacagttcaaattatggaggaggggaggtgcagggcagcagtgcccaggggagtacaggggagttgggggagcaggggctcatttttctttgtagctcagattcccaagcctgtgactttgagaatctttgtcttccttgcaacgtttcaatctgaggctcttggggagagggcagagttggagccggatggaagcctggtggtgagaggagtgggtggagggaacatgaagaacgtgtcaggcggtgtctttatttctggcaccttactttgcctactggagtttcccagtctgttccagacgcactctcttgatcctgagggggcctgaggaggcatgttggttgccagtgtgtgctcccctgaactcgattggaattggtcccacaaactttttttttttgagggagtctcacactgtcacccaggctggagtgcaatggggtgatctcggctcactgcaacctccgcctcccaggttcaagtgattctcctgcctcagcctccctagcagctgggaattcatgtgtccgccactacacctggctaatttttttctatttttagtagagacagggtttcacaatgttggtcaggctggtctcaaactcctgacttcaggtgatccaccggtcttggcccctcaaagtgctgggattacaggtgggaaccatcacgcccgacaaatcccacaaatttaggcattatgatacatcggagccaccacgccccaccaattacacatatttaagcattatgatatattgctacttttagaatcacttggtttttatattgtgtttttcccccccatttgtttgtttgtttattgagacagagtcttgctgtgtcacccagcctggagtgcagtggcgcaatcttggctcactgcaacctccacctcacagattcaggcaattctcctgcctcagacttctgagtagctgggattacaggtgcatgccatcacactcggctaatttttgtatttacagtagagacagggtttcaccatgttagccaaggtggtctcaaacttctgaccccaagtgatccacctgcctcggcctcccaaagtgctgggattataggtggaagccaccgtgcccggcctcccctccttttcattcagggattttaaatgttttatttgctccatctgttatgtatgattgccttgacgatttcagcttgaatgaaaattacatatttttgcctgtgattattaatattgaaacatattaaaataatacatgttcataatgaaaatgaaacattacaaataaatacacaggaaaggcagtattccccctccagttccactcttgaaaataaccagttaacaggatgatgaacatctttccatgatgttctccaagattcatataattatttgcaataatacaatggcatatatgggccaggtgctgtggctcatgcatgtaatcccagcactttgggagactgaactgggtggatcatttgaggtcaggagttcaggactaggctgtccaacatggtgaaaccccatcgctaaaaaaaacacaaaaattatttgggcatggtggtgggcgactgtattcccagctacttgggaggcagaggcacgagaatcacttaaacctgggagatgaaggttaccgggagccgatatctcactacttcactcccacttcggcgacagagtgagattccatctcaataaataaataaataaagagaaagaaagaaaaaaagaaagaggaaagaaacaaagaaaaaaggaagaaagagagagagaaagagacagagaaaggaagcaagcaagcaagacacaaaaagaagtcgtgtgctcaggttgctaagatcgatggtaagaacaaatcctctagtggtaaaagtgtaagaaggaaaaagaaatttctgttagtcttgttggtttcaccccaagctctgaaaagtacagcacgtgtgtgataagttcttagttaagttgaaaaaggcattaaatttgtgcatggaaatcataaacagaaatgtgttctgattgacagcaattgggtcaatgctacgcaaggttcaggcatccactgcgggtcttagaacaggtctcctgcagataagggagggctactatataatgtttctttcttttttctttaattataaagtattctcctgtttatataacaatttgccatcgatatcactttaggtataaagatattaggatatctttatagtagataaaaactaactcattatttgtaagagttaaagtatcttccattatatgagcatttaaaatactaaagtacttttgccaccagaaatagtgcttctgtaaatattcttttacttatatctttaaattttacttctgctgaaatgaattgcatgaggaaacaaatgtttgtgtataaaatgtaatatatgtatatatatttaatatgtgtatatacaacttaatatatacacatacatacaataacataaccaatttttttgttgttttttgagatggagttttgcaccgttgcccaggctggagtgcagtggtgtgatcttggctcactgcaacctccacatcttggattcaagtgattctcctgcctcagcctcctgagtagctgagaatacaggcatctgccaccaagtccagctaactttgtccttttagtggagatgggttttcaccatgttggccaggctgctgtcaaattcctgaccccaagtggtccactgaccttgccctcccaacatgctggaattacagatgtgagccaccgtgccaggcctaacatatacaatttaatgtatatacaaatataggttgggtgcagtggctcactcctgtaatcctagcacattgtggagctgaggtagggaactgtttgaacccaagagtttgaaatcagcctgggcatcatggtgaaaccctctctgtccaaaaaacacaaaaatgagttgggtgtggtggcacacgcctgtgctcccagctactcaggagactgaggtgggaggatagctggagcccgcaggtcaaggctgcagtgagttgtgatcatgccactgcacaccagcgtaggtgacagagtgagcccctgtcttagacaaaaacgaatcaaaccaaatataaagtttatgcactacacacttgatttctttccaaagggttttacaacactatactttcaccagcaatatatgcaactactcatttcctacatagtcactatcacttgtgtgcagtcaaggaacttagtaggcttgaattgtccaaatcctgcacactccaaagaaaggtttgactctagcccagctcctgggaaatagcctttaagtccttggactctcctgcctatctgggagttaacaaggtgatttattgtggggaccttggaccatgcagtgtcagcttgaccttgggaagggggagacagagaaactaaggtcatccaaatgggtactcttgtccatgtgaccaacctccagtaaaaccctcaaccccaaggttcaggtaagcttctcatctgggagtattttctgtactttctgccacatatcactgggtgaattaagcactgtccacatgatgccactgggagaggacaactggaagcttgtgctttgtctctcctggactctgccctatgcacctttttctgctgctgattttaatctgtatccttttgttgtaataaactataactatgagtataatagcttgactcagttttgtgagttcttctaatcaatcactaaacttttgggaccccaaaacacaacgttgttgcttctttaattgaattctccatgttatgtaagaaacctatgtgcataattgaaaatcccactctaagaaagagatttccatgcagtctactcccccaccatttctccaatgctcccaagtctactttctgaataatcaaatgtttcaattttctaaatttagattataaactatttataatctatatatctgagtgcttatctctgttatataataggtagatcctcctccttctgttttttttttttttctgagacagagtcttgctatgtcacccaggctggagtgcagtggcgtgatctcggcttactgcaagctccacctcctgggttcactcccttctgctgtctcagcctccccagcagctgggactacaggtgcccaccaccacgcctggctcatttttttgtatttttaatagagacggggtttcactgtgttagccaggatggtcttgatctcctgaccttgtgatctgcttgcctcggcctcccaaagtcctgggattacaggtttgagccaccacgcccgacccctccttcttaatatatcaacttgatatattacctgatggcttcctgttctgatagctgatgacttggctgacactcacctcttaccccagtgcctgaaccactttccttatatggtgctctcattattttctttttcttttcttttctttttcttttttttttgagacagagtcttgctctgttgcccaggctagaatgcagtggcacaatctcagctcactgcaacctctgcctcccaggttcaagtgattctcctgcctcagcctcatgagtagctgggattacaggcataagccaccatgcctggctaatttttgtattttagtagaagcggcgtttcaccctcttggccaggctggtctcaaactcctgatctcattatccacccacctcagcctcccaaagtgttgggattacaggcatgagccactgcacctggcctctctcactattttcaatggctctgttggttactgttcacaacattcaacaattagacttatacctcatttatttatttatttttaattttttctatttttaggtttaagggatacatgtgcaggcttgttacatgggtaaattgcatgtcactggggtttggtgtacaaatgagatcatcacccaggtagtgaccacagtacccaatagttttttgacccatagcctcatgccaccctccccactcaagcaggccccagtgtctttgatcccatctctgtgaccatgtgtactcaatgtttagctccaagttataagtgagaccatggagtatttggttacctaatgctgcattaattcatttaggataatggcctccagctgcatccatgttgctgcaaaggacatggtttctttttctacggctatgtagtattccatggtgtataattaccacattttcattatccagtgcactgctgatgggcatcatatatgcaacttcacactatactactaggctacagtaaccaaaatagcatagtagtggtacaaaaagagacacatagaccaatggtataggttagagaacccagaaataaagtcacacacctacaaccatgtgatcttccacaaagtcaacaaaagcgaggaatggggaaaggactccccattcaataaatgattctggaataactggctacccacatgcagaagactgagtctgggccccctacctttcaccatatacaaacattaactccaaatggattaaagatttaaatataagacctcaaactataaaaatcctggaagacaacctaggaaatactcttctcaacatcggccttggcaaggaatttttggctaagattccaaaaaagcaattgcagcaaaaacaaaaatagacaagtggtacttaattaaaccaaaagctggaggccaggttgggcagatcacaatgtcaggagtttgagaccagcctgaccaacatggtgaaaccctttctctaataaaaatacaaaaattaggtggttgtggcgcacacctgtaatcccagctattcaggaggctgagggaggagaatcacttgaacccaggaggcagaggttgcagtgagctgagaacgcaccactgcactgcagcctgggtgacagagcaagactccgcctcaaaaaaaaattaaataaagtaaaataaaagtgtaaacacaacaagacaaactatcaacagagcaaacaaactacagaattggcgaagatactcacaagcgatgtatccagcaaaggccaaataatatccagaatctatagacaacttaaacaaatggaacttaagcagaacccttactctttagcaagttctgtatgcataagcctctctttgttcttattttggtggcctctgtttatttacacaaagagaagaactgctattcctgtaaatcatggctttgaaaatggtcacagtttgctgggcatgcttgctcatgcctgtaatcccagcattttgggaggccaaggtaggtggatcacgaggtcaggagatcgaggccatcctggccaacacggtgaaaccccatctctactaaaagtacaaaaaaattagccgggattggtggcatgcccctgtaatcacagttactcaggaggctgaggcagaagaatcacctgaatccgggaggcagaggttgcagtgagccaagatcataccactgcactccagcctggatgacagagtaagactctgtctcaaaaaacccaaactgttcgggataagtggctcatgcctgtaatcccagcactttgggaggctgagtcaggtggatcacaaggtcaagaattcaacaccagcctggccaagatggtgaatccccaactctactaaaaaaatgcaaaaattagccaggcaccatggcaggtgcctgtgatcctagctacctgggaggctgaggcaagagaattgcttgaacccaggaggcaaagtttgcagtgagctgagatctcaccactgcactccagcctgggcaatagagtgagaatctatctcaaaaaaaaaaaaaacatggagaaactccatctctactaaaaatacaaaattatccaggcttggtggcacatgcctgtaatcccagctacttgggaggctgaggcaagagaatcgcttgaacctgggaagcagaggtttcggggaggcggaggttgaggtgagccaagatcatggcattgcactacagcctgggcaacaagagtaaaactctgtctaaaaaacaaacaaacaaacaaaacaaaacaaagaaaattacgcacaacttatttcctggtttgtgataatctgtgaaatacattttgaaatgaattggaattcaatacagtactattcacaccccaaatactcctaatatttcctttcagagatgatgacctggcactcttcctaggacttgacttctccctacaggtccccagtacaagtatttgtgattctgagttaattcattgtctacatgtgtgacaatgcaatgctcttgttgttgtaaagtaccaagatgagtcaggtccaaactgcacatttgtagagaacatagtatatgtgcaattgagcatgtatgtggttatgatactgaaaataatacgaacataggccagagcagtggctgatgcctgtaatcttagcactttgggaggccgaggcatggagatcacctgaggtcaggagtttgagaccagcctggccaaccagcctggccaacttgctgaaaccccatctctactaaaagtacaaaaaattagctgggcgtggtggcaggcacctgtaattccacctactcaagaggctgaggcagaagaatcgcttgaacccgggaggtggatgttgcagtgagccaagatcacaccactgcattccagcctgggtgacaagagtgaaattgtgtcaaaagaaaaaaaaaaaaagaagaacattggccttgggcgtttctttaggttgcctcctgtgttctatttatagcatgcctttatcagggttttggggtttgggactaattcccaactttctggcaccgtaaagtgtttcgattcatctggtattttccctgacccagacatggaataaaccatttatttaaagatccttggtttcttttattgaaaagtattatttacaaagcaccaaaatcttgggctgggtgaggtggctcaggtctgtaatctcaacactttgggaggctgaggcaggaggatcccttgaggccaagagtttgagaccgtgcaagatcaggccatgcacaatggctcacacctgtaatcccagcactttgggaggccaaggaaggtggatcactgaaattcaggagttcaagaccagcctggccaacatagtaaaaccctgtgtcaactaaaaatacaaaaaaattacccagaagtggtggcacctgcctgtaatcccagctacatgggaggctgaagcaggagaatcgcttgaacctaggaggcagaggttgcagagagccgatcgtgccaccgcacttcatcctgggtgacagagtgagcctccatctcaaaaaaaaaaaaaatctttgcaagatgaatgctacaaaatgagggcaaattgttggctataatcggaagactttttctcgattgaatgctctatcccaaagttctatgagaggtggtttgtgtgtgtctattggctgccttgtggatagtatgtatgattgatcctcagtgctttgggaattatgtaaaatagtttatattatgaaagtaattcaacctagcattaattgtgctaagtgttgaaaacgaaaagtgttgactacatctgaatgaatgagtatctggcttaccggttttgtttttgttctgttttggttttttttgtttgtttgtttttgttttttgagatggagtctcactctgttgcccaggctggaatgcagtgacatggtctcggctcactgcaacctccacctcctgggttctagcaagtctcctgcctcagcctcctgtgtagcagggactacaggtacatgccgccacccagctaattttttgtattttagtagagacacggggtttcaccctgttggccaaggctggtctcgaaatcctgggttcaggcaatccacccaccttggcctcccaaagtgctaagagtacaggcgtgagccaccgcaccagcctagcttacactttacagcttgtttcttatgcataatagtttttgtttggttggtttttgtttgtttttacaaacagggctatgaaaccatcaagatttgtggatcatcaaaaaacaaaacatcctgataaaattgagaaacaatgtttaaaaagtttaaaatcgaattttgaactgtaacactgttacttcttatttaagaaggacaaggagccgggtgaggtggctcacacctgtaatcgcaacaatttgggagaacgaggcgggtggatcacgtgatcccaggagttggagaccagcctgggtaatatggtgaaaccttgtctctactaaaaacacaaaaactagcctggcacggtgtgtgcacctgtaattccaggtactggaggctgaggcaggagacttgcttcaacctgagaggcggaggatgcagtgagccgagattgcagcaccatgctccagcctggactatacaacgacactcgtctaaaaaaaaaaaaaaaggataagcaaattatggtgaaataattgccctataaaattgcagaaataggccaggcgcagtgactcacgcctgtaatcccagcactttggaaggccgaggcaggcggatcatctgagttcgagagtttgagaccagcctggccaacatggtgaaaccctgtctctactaaaaatacaaagtcagccaggcgtggtggcacacgcctgtaatcccagctactcgggaggctgaggcaggagaatcacttgagcccaggagatggaggttgcagtgagctgagatcgtgccactgcactccagcctggctgacagagcgagactctgtctcaaaacaaaaaaaaaagaaagaaaaaaaaagattaatcgttgtaaaaccccatagtgctttatagttgctgaaactgtcataggactcacattagagaccgtaacttcaatagtgatgtatcacattgccattatttcacaatcactcctattgagcaataattcaattcaaagatgctttaatgagatgtcaggtaataccaaagagtagctgattaatcaagtaagtttcctattcagatcaatgaaatcagttactgagagtaaggcctgacaataggacatgtttgttatttcaataatgactgcaaactagaagaagagatacttgtaaaatctttagacactgaccgtaccagaacatctattcttgctgctataaaaacttggtttggggctgggtgcagtagctcacgcctgtaatcttagcactatcatttcctcatatgatatggaaaatgccgacctctgcatcctaactctaaactaatttcccactcacttactaagcttcagtcacaccaggctgctttctgtttccggaacgctccaagtgctctctgatttttcagggtctttagtgtagctgtgcctctgcttggactacccttccacactgctggcttctcaccaccaaagctcgagggttatctctcagacacccatcctatcaatgctacgcgaagtatccctcaagttactgcttataccacctattgatttatttcatagtatttatcacaatataaaattacttcatttcccccctttaatttaaaatcttttttttttttctccagactagaatgtaaacctcatgtgggcagcagacatgtctgcttattttttttttttttttgagacagagtcttgctctgtcacccaggctggagtgcaacggcgcgatctcggcgcactgcaacctccacctgccaggttcaagcgattctcctgccccagccctccaagaaactgagattacaggcgcccaccaccaggcctggctaatttttgtatttttagtaggggagcagtcggactctggactatatttcctggaggatcctgcaggccgataccacgtctcgcgagattttggcttcctcttagccaggtggcagaatctttcgctgtgcgcaattagctgctgccgcgccttggagtctggagcaacttggccaggctggccccgagcggaactagagaaagctgaggatgaggaatccggcttctgtccttttgtgtgtggagggctgaggagaggagtttgcgtgtgtgattgcgatggttgccgtgggtcttcgtggtctgtgactgtggctgtgtggtgctgactctgggtgatcaggtgggcgcttgtgactgtgcgcgctcggagtggatgtgtgtgtcctggacgagccgcgttgtgtgtgcggatgtggacaaccgttgactgtgtggttggggatgcgtgtcccagggtgggtgtgtgactttgcgtgtgtgtgcaatactgtgtgtgcgtgagttgcaggtctgtagctgtgcaggtgcaacttgtgtggccccgtggtctgtgtgagagaggagagtgtgatcggctgtgaggcagagggtaagtggatatagggaggcatgtgtgcgattggaactttgtgtgtccccctgagagaaaaaaccctttagggagttagggcgggtccttggtaaaactcctttaaatagagaacagcctgaaaaatcaggctgcaggcacagagaaggaaaactagcacagggggttgtcctaaagacattcctcagctgcattgataagggaccgaggcccaacatagaaatgcctttgtcctttgtgtgaccagcgggcttccaggaaatagtcactttttttgtgggcatgtatacggtgggctctgttaaattttgaagggaaggtgaaggttaaagaaagagagagagttggcggctctatggaggggaccaactaaatgccagagcccactgccgcttacaggctggagcaggaggggtctgggcagtatggcttgttgcctgggagaatgttgataaggatgtttcttgggcctttccccagcaggatgtgataaggaagtcaggcggttgggtaggatgtttctctcagcccaaaccccagtggaatgtttccctctgaccagggtctgtgaaatggtgggggcttacaaaacggtgcagcttggactagcaggctctggcggccactttccttttctggacatgctttggactgtgagccgagcctctatgaatcatcacttcagcccctgattggtcctgggccaaactttcactttagcccctgattggtcctggaccaaattttcacttcagcccgtgattggtcctaggccaaactttcacttcagcccctgattggtcctaggccaaaatttcacttcagcctccgattggtcccaggctaaggtcccagggccaaacgaagtagtgctttctccaagacagcccacagaccagtgagcacattcctcccctgcccagttcacaaaacccccagattcagcctcctagttggcaaacctcttttgggtcccctctccgctggggagagctttcttcttttgcttattaaacttccgttccaatctcatcctttgtgtccacgttccttaatattcttggctgtgagagaaagaaggcaaagacaagagcctttatcctaacaactcaattgctggagagaagattcgtgcatattctatgtggcatcacacgccatagccctgggattgaaagccatgcagtttatcggatggtgtcaatctcagtccaaatatgtaataagatctttcactttgctgtattttaggggtaggaatgagattgggggtttgatcaatagtttgtacccataggaccagggatttgcccagtcatctgtgagtaaatgcttaggccagtttccatgtctgtattgaattaaatactcatacggttctgtgattttgtcaaatacagatttggtctttgtccctattttctggcatacaactcctaaactccttggaatctcctaagtgcttgctttttttttttttttttttttttttttttttttttttttttttttttaaatggagtcttgctctgtcacccaggctggagttcagtggcgcgatctccactcactgcaacctctgcctcccggattcaaacaattcttctgcctcagcctcctgagtagaccacaggcatgcgccaccatgcctggctaatttttgtcattgttttcttttttagtagagaaggggtttcaccatattggccagtctggtctcgaactcctgacctcaagtgatctgcctgcctcaggctcccaaagtgttgggattacaggcatgtgccaccgcacccaggctttggctttttatatgttagtgattgaccgatagcttcaggatgggggctgctcatcagaaagaccaaggcaggattagagggttgggactttcagcccctaccctcccacccctggggagtggaggggactgaggactaagttgatggcaagtggccaatggtttaatcatgcctatgtaatgaagcctccttgcaaacccaaaaggagtggattcggagagcttccagagagctgaacacatggaggttcctggagggtcgtgcccagggagggaatggaagctctgtacgccttcccccatacctcacgctaggcatctcttcatctatatcctttggaatatccttataatcaaacagtaaatgtgtttccctgaggtctgtgagccattttattctagcaaattaatcaaacccaaagagggggtcgtaggaaccccaaattaaacccgtcagttggaagttccagagggtgggacttgtgactggtgtctgaaaggcgggcagttttgggggctgagccctcaatctgtggggtgacactatcacatggtagatagtgtcagaatcgaattggtggccacccagctggtgtctgctgcagaactgattccttgcttgctgatagggagaaatctcctcatattttgaggccacagaagtcttctgggtagattgttgtggttttggtgtgaagcagaggaagaacacaggttgagtttttccaaatgggttcacattgggggtcctcaacctcaaatccatcaactccatcgctgaatttttatttatgtatttatttttatttatgaggtagggtctcactctgtctcccagactggagtacagtggtacaatctcagctcattgcagccttcatctcctgtgctcaagtgatccttctactcagccttccaaataagctgaaaccagaggcacacactagcactcttgcataattaaaaataattttcagtagagaagaagactcactgtgttgtctgggctggtcttgaactcctgacttcaagcaatcctccccctctgcctccaaagtgctatgattacaggcatgagctgcctcacctatcactgattttctctttctttctttctttctttctctctctctctctttctttctttctttctttctttctttctttctttctttctttctttcttcctttcttttttttttgacagagtctcactctgccttgccaaggttgaactgcagtggtgtgatctcggctcactgcagcctccgcctcccgggttcaagtgattcttctgtctcagcctgctgagtagctgggattacaggtgcccgccaccacacccgaccaagttttgtatttttagtagagacagggtttcactatattggccaggctggtcacgaactcctgatctcaggtgatccacctgcttcagcctccaaaagtgcagtggcaggatcagggcatacggcagtcttgacctctggggctgaagggatcctccctcctcagcctcccaagtagctggattataggcatatggcaccatgccgggctaatatttgtaatgtttgcacagatggggttttgccatgttgcccagtctggtcttgaactcctgagattcaacaatcttcccacatgagcctcccaaagtgctggaattacagggaagagtcactgcacccggcctgtcactgcatttttaaagggaaggaggactatagtgagattcactaaggcttacaaaaaaggtagaaacctagatagattaaaagacagagattataatatccttgagatgataatattcaaatttagctttcatagatagggaaatttgaagtacatcagactataaggtggcattttgtgcaactaattaaaactatgttgtaactaacctgcacaatgtgcacatgtaccctaaaacttaaagtataataaaaaacaaaaacaaaaacaaaaaaaacaaaaaaaaaacaaaaaaaaaacaaaaaaaagaaagagagcaattgcattttcattactgagtaatattaagcaacaatgaaaataaatagaaataaccaagaaattgttatatttaaatcctccctcctttattggaaagagaagtattgatatttttagattctaatcaaaacttcgcttttaaaaaaattgatgattctatggagatagggagggaataacctatgtttattgaacacctaatattccacttacccgaatgtcatttattctatattctagtttttttgttgagacagggtcttgctctgttacccagcctagagtgcagtggggtggtcacagctcacagatatataccaccatgcctggcttattattttattttattttattttattttttgttatttttgcagagacggtgtctccctatatttcccaggcttgacttgaacttctgggctcaagtgatcctcctgccttggcatcccaaagtcctgggattataggcataaaccactgtgctcaaccaatattatagtgttaatagtagaagtgtcttagtgtactggaaaactttttctaaattttgaaaaaatattaaaaaacacgttggttttatttggccaatactgatttctttgctccatcattatttattggcattattagcctgttgactttcaatttccttacatccctttcactccatttcttttattttgtaccccaaatagaaattctttttttttttagatggattctcgctcttggctcttgtgacccaggctggagtgcagtggtgcagtctcagctcactgtaatcttcaccttccaggttcaggtgattctcctgcctcagcctcctgagtagcctagattacaggcaagcgccactacaccccactaattttttgtattcttttttttttttttttgagatggagtttccctcttgttgcccaggctggagtgcaatggcacgaactctgctcactgcaacttctgcctcccaggttcaagcgattctcctgcctcagcctcccaagtagctgggattagagggtgagccaccacacccgactaatttttatatttgtagtagagacagggttttgccatgttggccaggctggtctggaactcctgatctcaagtcatccgcctgcctcggcctcccaaagtgctgggattacaggcatgagccactgtgcccggcattttagtatttttatatttatttatattttgatagacagtctcgctctgttgcccaggctggagtgcagtggcacagtctcggctcagtgcaacctccgcctcccaggctgaagtgattctcctgcctctgcctcctgagtagctggtattacaggcacctgccaccacgcctggttaccttttgtattttaattagagacaaggtttcaccatgttggccaggctggtcttgaactcctgacctcacgtgatctgcccaccttggcctcccaaagtggccttgcttgaggccaggagtttgagaccagcctggccaacatggtgaaacctgctctctaccaaaaatacaaaagaaaattagctgggtatggtggtgtgtgcctgtattccaagctactttgatggctgagtcataaaaaatcacttgaacccaggaggcagaggttgcagtgagctgtgatcacctcactgcactatagcctgggtaacagattgagacttgtctcaaaaaaaaaaaaaattcttggcaggacgtggtggttcacacctgtaatcccagcactttgggaggccaaggtgggtggatcacctgagatcaggagtttgagaccagcctgactaacatggagaaactccatctctcctaaaaatacaaaattagctgggcgtggtggtgcatgcctgtaatcccagctattcaggagggtgaggcagaagaattgcttgaacccaggaggcagaggttgcagtgagccgagatcacaccactgcactccagtctgggcaacaagagcaaaactccatctcaaaaaaagaaaaaaaatctttactttggataaatacctagaaatggaatttccaggttggcctttagatattattaatggatttaatatgaaaaacctttacttgaggatgtataaagctttaaaagacagggtccctattcttaagttataaataaagcagcatttgtaaggtaatattcagaaaacatcagataatatcctataaagtcctcctgttcatgctgatgacattgtatggccagttaaggatgacacttcattctgtcccctgcaaccacggtcctgacatgtctaaatgacactggccctatgagaacactgtggatgtgaaagcatttcctcaagttatctttttggcctgctggttttaatctaatgatgggatatccaaagtgaatctaaaggagtgacatgattgtgcatctgttggggggaatcagagacagctagagcaaaggcagacacgtgctgaactcatctgtcttaagagctgaagcaagcagcagtattgctagcagagctactgcacatctgcacatgtgctccaatggctctgatctgtttttttcccagtatgaacctaatacatgaggcaagttagaaaatcggagttggccaggcatgatggctcacgcctgtaatcctggtactttgggagccagcgtgggtggctcacttgaggccacaattttgagaccagcctcagcaacacagtgaaaccccgtctctactaaaaatacaaaaattagctgggtgtggtggcaggcacctgtaatcccagctatgggaggctgaggttgcagtgagccaagatcaggccactgcacttcagcctgggtgacagagcaagactgtctcaagaaaaaaaagggaaaggaaaggaaagaaaatcacagcttgttaacctcttgcagctaaacacatatgcacaaaaattattcagtaaaagcaaaacagttttggtgtatcttgagattttgttttatatccaaaggaagactatatcttttatctttgaactactctttggaaaatgccttctatataacaaatgttatagttttcttctaattgggtcttgaggtctctcaggagaatggctataaactctacctcactctaatggggctctaggggaggggcctgtgggtctttagagtagcctttcaccagaaatttctttttcctggaccacagcctaatgctcaagtatctgacccatgaccaggtgtctcacaggaaacttgtttatactggcagatgcccttgtaacttttgtctgacctgtgtgcagtttattcctaccatgatacccactcttttttttttttttttgagactcagtcccgatctgttaccaggctggagtgcagtggcacaaccttggctcactgcaacctccaccatctgggttcaagcaattctcctgcctcagcctcccaagtagctgggactacaggtgcacgccaccatgcccagctaatttttgtatttttagtagagtcagagtttcaccatgttggccaggatggttttgatcccttgacctcatgatctgccctactcagcctcccaaagttctgggattacaggcatgagccaccacgcctggcctttttttttttttttttttttttttttttgagacaggatcttgctctggtgcctaggctggagtgcagtggcaggatcagagctcactgcagccttgacctcctaggttcaagcaatcctcccacctcagcctcccaagtagctgggactagaggcatgttccactacatctggctaatttgtatatgatatgtatttttgtagagatagggttttgccatgttgcccaggttgatcttgaacttctgagctcaagcaattcacctgccttggcctcccaaagtgctgtgattacaggtgtgggttaccacacccagccaatgtacatttaattatcaaagtactatctatactattttatggaagtactaattatcaaagtgcaatagaggttttgttgttgttgttgttgtttttcttttgagacagggtttcactcttattgcccaggctggagtgcagtggtgcgatctcggctcaccgcaacctccacctcccaggttcaagcgattctcctgcctcagcctcccaagtagctgggattacagacatgtgccaccacacccagctaattttatatttttagtagagactaaaatggtctctccatgttggtcaggctggtctcgaactcctgatctcaggcgatccatccgccttggcctcccaaagtgctgggtttacaagtgtgagccactgtgcctggccaatagaggtttttcaactttttgtagatatttttgaaagatcctgtcttcctttaaaaaaagagacaaggctggatgtggtggctcatgcctgtaatcccagcactttgggaggtcaaagcaggtggattgcttgagctcaggagtttgagattagcctggccaaaaggcaaaacctcgtttctactaaaaatacaaaaaaaaaaaattagctgggcatggtggcgcatgcctatagtcaaagctaatacagaggctgaggtgggaggatcacctgagcctgggaggttgaggctacagtgagctgtgattgtgccactgcactccagcctgggtaacagaacgagaccctgtttcaaagtgaaaacaaaaacaaaaaaaatgaaacaagagaaaaaaaacaagaaagaaagtggtgagggggaagtgcctatttattaagcttttgttgtaaatagtaacttgcatatcagatgtttactgtaatattcttgaagctttgccaggcctgcagcttgctgtgtgcttttcaactctatttcatttatttgggaaataatatatcaatgtactttattcattcccagctctaaccatggaatactgggaatgtcccattctatgaaggaggtttgccggccacaacaggaatattcatgaacatggaggtcctttgttgaagttacactaatttttttactcttccccattctgagcctagccggtctgctcactatattcgctccatccttcagcacccttccatctcttgcttcatcttaaaaacctttcctttaatttcaacagtgctgcctgagtttgtcatttcaggggttgggcatgttccaggatctgtctatagacttctctcaggaggaatgggagtgcctggacactgctcagaaggacttatacagagatgtaatgatggagaactacagcagcctggtctcactaggtaagtatgtctatccccaaataactcatgaattttgagtgtagctttcacttgtctgggtgacttttcacctgctgcttagggaattgttttgtgttttgtagattaatatatgggcagctctttgggttcccttcatcttctccatgcttcagacctttacaccttcctctagtccttcatgagtactaagggactaactttgaattcaggaacagcacgagtatgtcttacttcttttctttctttctttctttctttctttcttttttttttttttgagatgaagtctcactctattgcccaggctggagtgcaatggcatgatctcggttcactccaactttcatctcgggttcaagcgattctcatgtctcagcctcctgagtagctgggattacaggcacctgccaccatgcctgaccaatttttgtgtttttaatagagacggggtttcaccatgttggtcaggctggtcttgaactcctgacctcaagtaatccacctgttttggcctcccaacgtgctgggattacaggagtgagccaccatgcctggccatcttacttcttttcttatagacaggtctctctatcccaaagcctgatgtgatttccttactggagcaatggaaagagctctggatggtttcaagggacgtaccaggaggatggtgcccaggtgagtaaggactgagcagatgaggaaggcactgctgtttagaacccagcccatcagggaggcagcactgtaaaggtattggttgaggaatctcttctgcaaggtcccatgtaagagttgtggcctaagacacatggagaaaagtcaagatacccccgtcacacacacacatttttttaattttttttaatttgagagagagtcttgctcagtcacccaggctggagaacagtgatgcgatctcggctcactgcaacctccgcccccgggttgaagcgattctcctgcctcagcctctaaaggaactggcattataggcgcctgccaccatgcccagtaatttatgtatttttagtagagacagcatttcaccatgttggctaggctggcctcgaactcctgacctcaggtgatccacctgccttggcctccaaaagtgctggtattacaggtgtgagccactgtgtctggccaagaacccccttttacctccacctcttcagtctgtgctaccctcttgtcatcgtttctttccatttcaaagaataacattcccttcttcagaagccatcctgtttcctctatcttggagctacttctttcactttaaaaattaaacctgtgttgctgccttaaaaacaaatcttttaaaatatatttatttttcatactgatccttgactttttttgccttgtcttttcttggctagttttcctttaatgcagccatttcatgcatgaatggatattcattcactattttttttttttttttggatacagagtctcactctgtagcccgagctggagtgcagtggcgcgatctcgtctcactgcaagccaataagaagcgcttggggatgacctccctacaagcacagcaaaacttttcttgcgcatttctgcgctggaacgcctacccgctccgccaaaccaaaactttactatcacccttagtgccgtgtcctgcactttcttggagatttgtaccaggcgctggagactctcccacctggtccatgcccgccgcccggtgagcactgagacccaaccttgtgcaccgccagtcttgttatcaacaaacaggctagtaaattataaaaaataaaataaaggaaatgtagctggccgtggtggcatgtgcctgtaataccagctactccggaggctgatgcaggagaatcgcttgaacccaggaggtgaaggttgcagtcagccgagatctcaccactgcactccagcctggatggcaagagcgaaactccttcttgaaataataaataaaataaaggaattggggccgggcgtggtggctcacgcctgtaattccagcacttttggtagccgaggtgggcggatcacttgaggtcagaagtttgagaccagtctggccaacatggtgaaaccccgtctctactaaaaataaacaattagtcaggcatggtggcgggcgcctgtaatcccagctatttgtgaggcggaggcacaagaatcgcttgaatcccggaggcagaggttgcagtgagccgagctcgtgccactgcgctccagcctcggcgacacagcgagactccatcttaaaataaaataggctggctgagggtgctcatgcctgtaatcatagcactttggacgccgaggcgggtggattgcctgagctcaggagttcaagaccatcctggcctatatggtgaaaccccatctctactaaaaatgcaaaaattagccgggcatggtggcgcatgcctgtaatcctagctacttgggaggctgaggcaggagaaccgtttcaacccaggaggcagaagttgtagtgagccaagaccgccacattgcactccagcttgggcaagaggattgaaactccatctcaaaaaaaaaaaaaaaaaaaaaaaacaaataaataaatataaaagaaatagacaaagcaaaccttaatgcatgaactcaaacaaatgctttcactgccaggctccatctttgcaaatctgaacctagaacaatgtgcacgtttctaactagcaattctggaggacagatcagggaggcagtgtgagcttgcttttctgcaatttaattgactggtcagtaaagtcagtgtttgcaggcattttcaatgttctgtagtgggcttcagttcctatggcagtgtggcaggccaggtttccaatagcaaccagaagagtttctactaaccattttctataattttgatgaatgcataagttaacgttaaagaaatggagaaactggtgcctgagtatcagggatggaatgtgaaaacaaacctattgaaaccccgcctgggttttctcagaccctaaagtctgatcgaataatgatagcattggtacacattcacttcggcctgtcttaagattcagaaactttcccagatgctagagaaatctttccagactctagacccaagttaaagattagatgttgattgaatgaaacactcctgcttgtaggtgcaatcccacatggagcttaagatgtatataagcactagaaaaaaaaacttgtaactttgagttgatctggtgagttacctggcgcttctccctgtaaatggctgcagaaataaacttccttctttcccagtctgtctgtgtcttgttattgagcaattgcggtggacctgcccagcaaagtcctcttttgtgtggttatctgggactccttttggagggaacattttaaactttccatttcagagcattctgttggcactcttacactgtttttctctgcctaccctgggacctgagttctcctggacgtgaatctccagccacagagcctagaagcccattcctccacattctgtgactgttccccaaacacagggagaatttgcagaaaataagcccaaaaatcttgccattctttgcaataaaaccccacattacaaactgtggaaaacaggattttagcctgaataggtttttcctctatttgaaaccctttacaattttggagggaagtttccaaatcaatcagtaagtaccccccaccccaggtttatccttatgtaaagtgccccctttgcacatgcaagattgaataaaccttgaaaatattatgctaagtgaaagaagccagtcacaaaggaccacatgttatgtaattccatttaaataaaatgtccaaaatagaccaatacatagaaacagaaagtagatttgtggtggcccagggttaggggagttgtggggaaatggagggatatggggtttacttcagggtaatgaaaatgatctaaaatttattgtggtgatgtttgcataacagtgcaaatatactgaaaacctttgaattttacactttaaatcagtggcttctgtggtatgttatcaatatttctcaataaaacttcaaaaaaaaaatagtgcctatgtgtctttttatgtattattcctccagagtccagtccatagtttttacatttgatgaagaaattaagattttgttttgtcttcttcttcttcttctttttttttttttttgagacagaatctccctctgttgcccagactggagtgcattggcacaatcttggctcagtgcaacctccaggttaatttttgtatttttagtagagacagtgtttcaccatggtggctagactggtctcaaacttctgacctcaagtgagtcccccaccttggtttccaaaattgctgggattacaggcgtgagccaccatgcccagcccaagatttagtttccgttgttttgatgccctagggccatcttattctaccttaatttctgacgcatcatctcagtggaaattttacattaggttccaaagtattttcctcttttgaagattttatcagttgagtacagtagctcacacctgtaatctcaacactttgggaggccaaggtgggaggatcagttgagagcaggagttcaagaccagtctctgcaacatagtgagacacacatttctacaaaaaaaattttaattaggtgggcatatttgtgcattcctgtggtctcagattactacgtaggctgaggagggaggatcacttgagcccaggaggttgaggctacagtggccatgattataccactgcactccagcctgggtgacagagcgataccctgtcttaaaaaaaaattaattggaattttttttagaaaacaaagtatacacttagtgacttgatacaaatgaatgaatttgataatctacagaaaataaaacaaataaataaataaaaacccaaagccattcttcttatgtgaatctctggtgtctctgaattataagaattgtgaattatgattaataacaaatatgcatgacaaggactcagtaagggataggtgttgataaactgcaatgcacacttactggagtgaggcctttaaagatgtacaagaaaaagaaagaaaaggcattgaaaaattgcattgcctaccaaaacgctaaagtttacctaagtccattaatcagcacacacacacacacacacacacacacacacgcaataggtgtgtaaaatggtcaacacagtctcctatgaatgtatccttttattaataggtctgtgggggtaagagatgaggttctatagatcctggaatcagggatggggaatctgtggggtccctgggttgagagatgagggtctgtagattactgatgggtggtctttgggatagtgatgaggtccatggaatcaattcttgtgagtatgtagggtcagtgatgagggaatctggtgtcagtgatgggatgtgtgtggaatcaatctttgaaagccagatttgtggtgtcatctctcaggctgacacatcctgatctgtgtgtcagtggtggaaattctatggggtcagagtgtgactgtcaggtccctgacactgtgtgttctgggtctggccaagtgcacggattcccttgcctggtcctggctggagaggcccttctcaaggactcctcacatgaaaggtgggttggtggtgggttttgtttttgcttttgttttgtggtggaggtgggggtgggttggctttttctttagggtttagttttgtctcctagagaccacagacacatgcaacttttaggaagaaatttttgtctgggtggtcgctaggtcctttgggccaagccatctaatgggagtaaagctgaccattccctcagcgcggttcagatctagactgtcattttgaggtgtcctcaaggtggcgtgcaagtgggttgtggctttgagtggcaggtgtgtgggaagaaacaactaagaagacccaggagcgctcctagcctggatctgtcacagctggaagaacagcctccctgacccatcaggcgccaatgggaggtacctctgggctttgagaggctggtggaggtgggacctccagacctagagattctgggcacagaagcctgttactgccagaccctgaggcgttgccatgggatccaagggtgtttcaggtcagatcagagcctttctcagataattatttcggtaacttgtccagcgcacgctgctatgaaggcttaatgtgccgtctcccgcagtcttctttggtctgagagccacttgtttcttacatccctgtgctaatctcaccatctgctcctacataccccaggcatttgccacatgctggtcctctctttcctgacaggcgggacgtctctccagcttctgtgaggacaattcaaattatggaggagggggctgatgcagggcagcatgctgaggggagtaccgggcagttggaggagcaggggctcatttttctttgtagctcagattcctaagcctgtgactttgagtatcagtgtcttccttgcaaagtttcaatctgaggttcttggggagagtgcagaattggaacccgatggaagcctggtggggagaggggtggatggtgggaacatggagaatgtgtcaggttgtgtctattcctgacaccttactttgtctgttggagtttcccagtctgttccaaatgcactctctcgaccctgaagggacctgaggggggatgttggtcaccagtgtgtgctcccctggactcgattggaattggtcccacaaagtgttatttatttatttatttatttggagggagtctcgctctgtcacccaggctgcagtgcagtggggcaatctcagctcactgcaacctctgattcccaggttcaagtgattctcctgcttcagcctccctagtagctgggactacaggtgtccgccaccacaccttgctaatttttttatttttagtagagacagggtttcacaatgttggtcaggctggtctcgaactcctgaccaggtgatcgacccaccttggcctctcaaagtgctgggattacaggcgggagccatcacactccgccagtcccacaaagttaggcattatagtacattgctacttttgaatcacttattttttacttgtgtttttccccctccttttattgattgattgacacagagtctcactgtgtcacccaggctgaactgcagtggcacaatctcggttcattgcaacctctgcctcccgggttcaagcgattctcccacttcaaccttccaagtagctgggattacaggtgcatgccatcactcctggctaatttttgtattttcagtagagacagggtttcaccatgttggctaaactggcctcaaacttctgaccccaagtgatccacctgccttggcctcccaaagtgctgacataggcatgagcctcctttcccagacttccctccttttccttcagggattttaaatgttttctttcctccatctatttaataatatgtgattgccttgaggatttcaacttgaattaaaattacatatatttacctgtctttattaatattgaaacatattaaaataatacatgttcataatgaaaatgaaacattacaaattaatacacaggaaaggcagtattccccttccagttccacccttgaaataaccagttaacaagatgatgagcatctttccatgatgttctccaagagattcatataagtattggccagcaaacaacagaatatataggccaggcatggtggctcatgcctgtaatcccagcacttcgggagactgaagcaggtggatcttttgaggttaggagttcaagactaacctggacaacatggtgaaaccccattgctacaaaaaatacaaaaattatttggacgtggtggtgagcgccttaatcccagctacttgggaggtggaggtacaagaatctcttgaacccgggaggagaaggttgcagtgagccaatatcgcattactgcactccaacctgggtgacagactgagattccatctcaataaataagtaaatacataaaataaagagaaaaaaagaaagaaaaaagaaaaagaagaaagaaagaagaaagaaagaaagagaaagaaagaaagaaaaagaaagaaagaaagaaagaaagaaagaaagaaagaaagaaagaaagaaagaaagaaagagtgttcctatttctccacatcctctccagcacctgttgtttcctgactttttaatgattgccattctatctggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaattttgtttgagttcattgtagattctggatattagccctttgtcagataagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccgtcttgaattgatttttgttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcccacgtatgtttattgcagcattattcacaatagcaaagacttggaaccaacccaaatgtccaacaatgatagactggattaagaaaatgtggcacatatacaacatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgttgtggggtgggggaggggggagggatagcatgggagatatacctaatgctagatgacgagttagtgggtgcagtgcaccagcatggcacatgtatacatatgtaactaacctgcacaatgtacacatgtaccctaagacttaaagtataataaaaaaaaaaagaaaaagaaagaaagaaagaaagaaagaaagaaagaaagagaaagaaaggaagaaagaaagaaaaagagagaagtcttgtgctcaggttgctaagatcgatggtaagaacaaatcctctagcggtgaaaatgtaagaaggaaaaagaaatttctgttagtgttgtttgttgcaccccaagctctaaaaagtacagccacgtgtgtgataagtgcttagttaagatgaaaaaggcattaaatttgtgcgtggaaatcataaacagaaatgcgttctgattgacagcaattgggtcaatgctacccaagtttcagacatccactgcacgtctcctgcagataagggagggctactatataacgtttctttcttttttctttaattgtaaagcattctccttttttaatataacaattggccacatatatcactttagatataaagatattaggataccattatagtagataaaaagctaactcattctttgtaagagttaaagtatctttcattatatgagcatttaagatattaaagtacttttgccaccaaaaatagtgcttctgtaaatattcttttacttatatctctattaatttttacttctgctgaaacgaattgtatgagcaaacaagtgtatgtgtataaagtgtgatatatgtatatatatttaatatgtgtatatacaacttaatatatacacatacatacaaaaacatatacaatttttttgttttgttttttgagatggagttttgctctctcatccaggctggagtgcggtggcgtgatctcggctcactgcaacttccactgcttggttcaagtgatcctcctgcctcagcctcctgagtagctgggaatacaggcatctgccaccatgtccagctaactttgtttttttagtggagatgggttttcaccatgttggccaggctgctctcaaactcctgacctcaactgatccgcccaccttggcctccctaactgctggaattacaggcatgagccaccgtgcctgacctcaagtgatccacccaccttggcctcccaaaatgctggaattacaggcatgagccaccgtgcccagcctaacatatacaatttaatgtatatacaaatataggttgggtgcggtggctcactcctgtaatcctagcactttgggaagctaaggtaggggattgtttgaacgcaggagtttgaaatcagtctgggcaacgtggtgaaacccctatctgtacaaaaaacacaaaaaatagctggatgtacttgcaggtgcctgtggtcctagctactcaggagactgaggtgggaggatagctggagcctgagaggtcgaggctgcagtgagttgtgatcatgccactgcacccccagcgtgggtgacagagtgagaccctgtctcagacaaaaacaaaaacaaaccatatataatgtttatgtgctacacactcgatttctttccaaagggttatataacactgtaatttcaccagcaatatgtgtgactactcatttcctacgtatttgtgtgcagtcaagaaaacttagtaggcctgaattgtccaaacctcgcaaactccaaagaaaggtttgattctatcctagctcccaggaaataacttctaagtctttggaatctcctgcctatctgggagttaacaacatgatttattgtggggactttggaccatgcagtgtcagcttgaccttgggaagggtggagacagagaaactaatgtcatccaaatggctgctcttgtccatgtgaccaacttccagtaaaatcctcaacaccaaggctcaggtaagctttttgttggggagtatattctgtactttctgccacgtatcactgggtgaattaagcactgtccacatgatgccactgggagaggacaactggaagcttgtgctttgtctctcctggactttgccctaggcacctttttctgctgctgattttaatctgtatttttttgttgtaataaactgtgagtataacagcttcactcggttttgtgagtctttctaattaatcactaaacctttgggacctcagaacacaacattgtttcttttttttttttttttttttttttttttttgagacagagtctcgctctttcgcccaggctggagtgcagtggaacacaaccttgtttcttctttacttgaattttacatgttgtgtaagaaacctatgggcataactgaaaaatcacaaactaagaaagagctttccatgcagtctacccccctcaccctgtttcttcagtgctcccatgtctacttcctgaataaccaaatgtttaaattttctaaactatttctaatctatatatctgagtaattatctctgtgttatataataggtagatcctgctccttatcaatatatcaacttgatatattatctgatggcttcctcttctgatagctgatgacttggctgacactcaccccttaccccagtgcctggatcacttttcaaacatggtgctctcaccattttctttttcttttcttttcttttctttttctttttctttttctttttgagacaaagtattgctctgtcacccaggctagagggcagtggcatgatctcggctcactgcaacatccacctcccagattcaagtgattctcctgcctcagcctccagagtagctgagattacaggggcgcaccactacgcctggctaatttttgtagttttagtagagatggggtttcatcctctcagccaggctggtctcgaatgcctgacctcatgattcgcccatctcggcctcccaaattcctgggattacaggcatgagccaccgcacctggccactctcactattttcaatggctctcttggtcacctttcactcaggagagtatctgaggcaggagaatcgcttgaacccaggaggtggaggttgcaatgagctgagatggtgccattgcactgcagcctgggcaacaaaagtgaaactctgtcaaaaaaaaaaagcagaaaagaaaagaaagcaagctcttcctccatatacctgtaaggatcattgtcttaattttcttcatgtcttaacatgattcttgccttgtcaaagatcatcctatctgaaattgaaactatttacctcttgccttttttccacagcacttaaaacttttatttttgagatggagtctcactctgtcacccaggctgaagtgcattggtgtgatctcagctcactgcaacctccgcctcccgggttcaagtgattatcctgcctcagcctcccaagtagctgggattacaggcatctgccatcacgcctagctaactttttttttttgtattttagtagagacagggtttcaccatgttggccaggctggtcttgaactcctttcctcaggtgatcagaaccacttcggcctcccaaagtgttgggattacaggcgtgagccaccacacacagccctggctaatttttgtatttttagtggagacagggtttcaccatgttggccaggctgatctcgaactcctgacctcaagtgatctccctgcctcggcctcccaaattgttgggattacaggcatgagccactatgttcggacttctttttaacaaaccatctctgttcttatattatgtccactagaatgtaaacttgatgagagcaggagatattgtcaattttgttcaatgctatttatccctagagcctagaactgtaccatgcacatggtaaggagacaaatatttgttgaatgaatttattgagcagctgttctcagatttttggcctcagaaattctttactctctgtttctttactcctgacctgaggtgatctgcccacctcagcctcccaaaatgctaggattataggagtgagccaccacgcccagccgcccaactcatttttgtatgtttagtaggcacatggggttttgcaatgttggccaggctggtctcgaactcctgacctcaagtgatcccccacctcagcctccaaaagtgctgagattacaggcatgagccaccccacccgactaaataaaccaaaaactttagataagtgaatttggaggaaatatttataacagataaaatagacaaacagataattctaatttattgtctctctgccttaataaaatattagacaataccctaagaagaaagaaacaaaatctaaaaattcaccattcacaaacacaaatagttagaaaacaaagtcaaaacctaagaacatgttgaccacttatctgtcctctgaaatcggctcttaaatgtgttgaacatagattgacttgggattaggaaatttttaaaatattttttaaagtttcactttttggaattgaaaattaatccagattatgtaatatacaacatttggaatttaccaatcaatactctatcattttatttttcactcttcaaataatttcttgttcaagagtttaaaatgcttttaaaattaatagattctgcaggctatagtctgcagagactgtctccacaaaaaataaaaatatatatacttttaaaatatatataaaatatatatttatttaaatgtacatgttttaagtatataaaatatatttttaaaatttcattttttcaccggattgtatggtaagcatatgtttagtctggcaggaacttgcaaaactgccttctacagtggctgtcccactttgcattctcagcagaaatagagatgagttcctgtcgctccatatcttcaccagcatttggtgttggtgtttgcattcaagccagtctaatagatgtgtaatgatatcattgttttaatttgaatcccctagtgacatatggtgttgagcatcttttcagaggtctaagaaatgtgctgggcatggtggcagacacctgtggtcccagctactcaggaggctgaggtgggagcgttacttgagccctggaagttggggctgcattaagccatgattgcaccactgcactccagcctgagtgacagagctaaaccctgtctcaaaaagataaataaggccaggtgcagtggcccatgcctgtaatccaagcactttggaaggccaaggcgggtggatcacgaggtcagcagatcaagaccatcctggctaacacagtgaaaccccgtctgaactaaaagtacaaaaaaatagccaggcatggtggtgggtgcatgtaatcccaacttcttgggaggctgaggcaggagaatcgcttgaacccaggaggcagaggttgccatgagctgagatcacgccattgcactccagcctgggtgacagagtgagactccatctcaaaaaataaataaataataaataaataaataattgacttaatttttagaacagttgtaggtgtacagaaaaatagagcagaaggcatactgagctctaatatccgcctcatactatagtacacacactttctctattatcatcttgttaatgtggtacatttgttatgtctgatgagccaatattgatattattaagttcatggcttatattaagattcactctttgcgttctaccatttatggtctttgacaaatgcttaaggacatatattcaccattatagggtcacacagaaaagtttcactgccctaaaaatcttctgtgttccacctattcatccttccctccactcaagcccctggccaccactgaactttttataatagcatctgcctagttttgccttttctagtattccatataattggaactctacactatgtggcctttttgtattggcttctttcacttagaaatacgtgtttaagattcctccatgtcttttcatgccttggtagttcatttctttttattcctgaagaatattccattgtatgaatgtttcagagttagtttatccatttctctattgtaggatatcttggttacttccaatctttgtcaatttgttgtaaacattaatgtgcaggatttgagtgaatataagttttcaagtcatttgggtatataccaaagaatgcaattgccagatcgtatggtaagcctatgtttagttttgcaggaatttgcaaaactgccttccacagtggctgtaccactttgcatttgtggcaacaatcaatgagagttcctgtagctccacatcctcaccagcatttggtggtgtcagcatttggatttgagccagtctaatagatgtgtagtggtatctcatcattgttttaatttgaattctctagtgacatatggtgttgagcatcttttcagatgcttgtttttgctgcctatataacaaagggtagatacagatgatggacttcagggaaagagcttgctatgacgataggaagctgcaggcagagatgatctcagggttaactggacaccaactgtgccttctcctgtcacataaaatgtggtctacctaagttttgactggaaacacagactatctggttgtccataaatatttctaactgaggcttaaggtttatgcatgtttcgaccaaaaggtgataccaccccaatatataagcaggtcggggtacaacaggtaatgactgtcagagatgttgagagtctacattgaatggtgtcactggctgcccatgcctttctcattaaggactttcacttttcatttgccacatgaaaggccactgagttaggctacatcttattttttctcttgagaatctctagtactgagaaatttttgcattctgggctacactgggttcataatctgactatatatattgtgtgtgtgtttgttccttccctaaaatgctcagttcagctgcagttctagaggtaaatactactaggtttccattttagagagttgaagatctgaggtctggagaggttagtgtgtagaaagttatgtttaataagtggcaagaccatgtggccaggtcagataagctgccttcagattttactctcgaacttctactggataatgtcttttcattatagaaaagaaaagagggaacttagatgtttttttcaaaatcattgactatagaatttctttcaagatatgatgaaaagcaataattgtctcattttatattacctataattattgctcaccagaaattgattatcgatgcagcaatcttttacgttcctgtctgctttattatgcatggccgggcttcattgtaaataagagatccaagattcagaaatatctttaacttgcaatgcttggtcacaggtatccatctgaaaaatattttgctcattagccatatggactcatatggtaaactacagccagagactcaaaatgtggaaaggagaaagggctatcagaagtcctgtgtctccttacattttgtgtttctattcatatgtatctagaatcatgagaaatttgagcaaatgggaaatgcaaagtcctagtccatgcatacccacatttcagttatctgcattattgcacatttaaatttataatgcatacataggatacaattcaataggtataaaaatgttaagtaatcttttctctcatgcaccccagtcattcagtgctcacttttgagtcagcattttaattctgttgtgcatactttcataattttttttttatctttttttttttttttttttgaggcagagtcttgctctgttgcccaggctggagtgcagtggcatgatctcggctcactgcaacctctgccttattgattcaagagattctcctgcctcagcctcctgagtagctgggattacaggcacgtgccaccacgcctggctaattttttgtatttttagtagagtcggagtttcactgtgttagccaggctgaacttgaacaactgacctcataatcttcccgcctcagcctcccaaagagctgaaattacaggtgtgagccaccacttccagccttctattcctttatatgtgaaaatcattttaacattccacatataagtaaggtcatgcaatatttttctttctgtgtttggccaacttcacttggtataatgccctccagtttcatccatgttgtggcaaatggaaagatcttgtacttttttagggctgaacacagaagttattttcatgtacaaggttgcagttgccatacacacaaatatgtatgtatgtgtcatagtcatatacaattttaaatacatatatgtgttctatgcatatataagtatttctctattttcacagaaatgtcagtctaaatcagtacctagggagggtcattgttttcttaatctacaaatcaagacaaagtatgagtggctgcaccctagtttaataagtcctctattattgaggatgttttcctgtttccttttgtcattgttgttgttgttttgttttgagacagagttccactcttttgtatgaagtggtgtgatctcagctcgctgtagcctcccgagtagctgggattataggtgcccgccaccacacccagctaatttttgtatttttagtagagacagggttttaccatgttggccaggctggtctgaactcctgacctcaggtgattcgtccaccttggcctcccaaaatgctgagattgcaggcatgagccaccgcacttggctgctttcaccatttcagactgagcttggagaagaacctgaagaaaaacatgactttaaaattttgatgaatggagaaatatctttccattcaccttcctttcctctatttcattcttattttaaaatatacaaacaaagatatggatacatcagttattaaagaaacatctatgtgatacctatccaggtgaagaaatagagcactatcaccactgagaagtcctctgtatgcccctaactgatcctaaagtcttccttccccttattagtaacagatacaacagatatccacattacctgtgggtatctgccatcctctccttggttctctttataattttattatgtattttctttcttttttttttttggagatggagcctcactctgtctcccaggctggagagtagtggcatgatcttgactcactgcaacctctgcctcctgtattcaagtgattctcatgcctcaacctcccaagtagctgggattacaggcatgggccatgtgccaccatgcctggctaatttttgtatttgtagtagagatggagttttgcatgttggtcaggctggtttcaaactcctgacctcagtgcctggccttattatgcatttttatatgcctaaattaaagtctgattttgcctggtttttctcttacataattggagtaaaagtctgtatcctcgtgcatttggccccttttactcaatattaagtatttaagattcacagtgagcattgtttctgcattctattaaaacagtacaccagccaggcatgatggctcatgcctataatcccagcactttgggaggccaaggcaggcagatcacttgaggtaaggagttccagaccaccctagccaacatggtgaaactccgtctctaataaaactacaaaaattaggccacattgtggctaatgactgtaatctcagcactttgggaggccaaggcaggtggatcacacggtcaggagatggagacaatcctggcaaacatggcgaaaccacatctctactaaaaatacaaaaaattagctgggtgtggtggcacacgcctatagtctcagctactcgggaggctgaggctgaagaatcacttgaatctgggaggcagaggttgcagtgagccaagtttgagccactgcactccagcctcggtgacagaacgagattctgttaaaaaaaaaattagccaggtgtggtggtgtgcacctgtaatcccaattattcgagaggctgaggcaggagaatcagttgaacctgggaggtagtggaggttgcagtgagccaagattgtgccctgtactccaacctgggcaatagagtgacagtctcaaaaaaaaaaaaaagcccaggcccagtggctcccacctgtaatcccagcactttgggagtctgagacaggtgcatcacctcaggacaggagtttgagaccacccttaccaacaagggtaaaccccctctctactagaaatacaaaaatttactgggagtggcggcgtatgcctgtaatcccagctactcgggaggctgagacaggagaattgcttgaacccgggaagcagaggttacagtgagccgagatcgcaccactgcactccaacctgggtgactaagcaagacgctgtctcaaaaatatatatataaatttatatttatatacataaaataaatataaaaaaaataagtaaaaataccgtacaccagtgtgtatcccttcattgttggtggacatgtgggttgtgttcatttttgtcagttacaaatgatgctgttgtgaacatgtttgtatttctatttggttaccattagtgtgtatttatgtacagtataaagcaagaggtgaaaccataggttacagggtaaacatatcgtcagttttaccaggtattattggtttcatcccaatgttaacacaccaactgtcagtcttacaatgtctgataattcccaaatctttgcattcttcttgacatttaattttgtcaaaattttaatttgagtcttttggtgggtatgtggtgatgattgtgatattaatttactgggccttttcttctctgtaacaggccctgtcaagatatatgtgtggtgtggcaggggtaggagcccctagaggtagcatgggctctggaatccttaatcatcctatgtgaaaaagttgatggggcagtgatttttctttctttctttttttttggggggggggacagagtttcgctcttgttgcccaggctggtgtgcaatggcatgatctcagctcactgcaacctccgcctcccaagttcaagtgattctcctgcctcagcctcccaagtagctgggattagaggcatgtgccaccacacccagctaattttttttatttagtagagatggggtttcaccatgtttgtcaggctggtcttgaactcctgacctcaggtgatccacccacctcagccccctaaagtgctgggattacaggcatgcaccactgcaccctaatatttcctgggtgcagtgttgtagccagggtgcaaagccacttaatgattctgtcatccaaatattatatcttctcccttccccttgagatatgctcattcccccatacaattaaagaatctcaattactcttgaaggggcataaaatcctctctgtctaatcatgggtccttccaaattatttgttggctgtgtttaaaatatgaaaaagagaatgtagattttgttttcttctttctgcttaacctgaacaaaatgtcatagatacctcttaacctgttgctaaaccaaggagagtcacttgaataatgaacaagactggagggacgccacatggataatttatcattacactatcatcacatacatggaactcatcaatgaagcttatgaaaaaaattgagtcatttgtggaaaagtgtaaagagaatataggagatgtctcaagtgaagagaaaaaagctgcagaaaagaattacaaaaaaagagtgttaagatgcaaacacaaattcagagattcaggagcacaaagggctaagttaagggaaaaaagagttaccaatattttcttattcattatggagagcaggatgaattctttaaaggtcaaataattgtgagtctgatatatctgatgataatttgtatttctaatgttgtaaatggttgtgaatttatggtcattattcctgtttcctttagactagtgaccatgagtttgattgacaaaaacccattgggttagtattgttatctatgtgtgttcatcatgctatgtgttaaaataagtccatcaatttttatcttgtgtttgttttcatttcattttagtttaggttctttgggacagggtcttactctgtcgcccaagctggatgtgcagtagcaagatcacagctcactgcagcctctacatctccaggctcaggtgatcctcctacttcagcctcccaagtagcagggactacaggcatgagccaccgcacctggctaatttttgtattttttgtagagatggggttttgatatgttgctcaggctggtctcaaactcttggactcaagtgatctgcccaccttggcctcccaaagtgctgggatgactggcatgtaccactgtccccgacctgttttcattttattaattggctgattcatttagacacataatcatcaagtcaaatctcactctttccttagcatttcccttcagtttagcttagaatatctattcctattttaaaacacatatgattattcaagtgtggtggcacatgcctgtaatcctagctactcaggaggctgaggcaggagtatcacttgaacctgggagagtgaggttgcagtcagtcgagatcgccccactacactccagcctggatgacagagtgagactccatctcaaaaaaacaaaacaaaacaaaacaaaacaaaatgttttctccagatcatttttacatttaattattcagtctgctttaactataccttaatgtaaaaaattcagtaaatttaactcctacacactattagttaatgtacctaacacggtttattgaataagccagtccattcccaacagcatcaaaagtaattacatttcccaatgtaaattaatacagccattatggaaaataatatggagattcatcagaaactaaaaatagaattactgtatgttccagcaatccctcctgtggttgtatagctaaaggaattgaaatcagcaaactgaaaagataactgcactaccatattcactgcagcattattcataatagctaagatatggaagcaacgtaggaggccagcattggatgaatggataaagaaaatgtgatatatgtacacacacacacacacacataaaggaatactatccactctttattttatttatttattttttatttattttatttcattttattttggacgtagtttcactcttgttgcccaggctggagtgcaatggcatgatcttggctcactgcaacctccacctcctgggttcaagcgattctcctacctcatcctctcaggtagttgggattacaggcatgcaccaacaagcctggctaattttgtatttttagtagagacaggtttcctccatgtatgtcaggctggtctccaaatcccgacctcaggtgatcagcccacctcagcctcccaaagtgctaggattacaggcatgagccaccatgcccgatcttactatttgctctttatctttcctttgagatgaagtttccctcttgttgcccaggctgaagtgcaatggtgcgatctcagctcactgcaacctctgcctcccaggttcaaatgattctcctgcctcagcctcccaagtagctgggattacaggcacccgccaccatgcccagctaatttttgtatttttagtaaagagggggtttcacaatgttgctcaggcttgtctcaaacacctgagcttgagtgatccaccggtctcaggctctgaaaatgctgggattacaggcgtgagccacggcacccagccaaaaacacagatgagtgtattaatagtctgaagcactgtaaaatattgctgagaaaacagatcactaatatcatcattacagagcacaaaataagttctgctattattaggaatatcatagctctgactaacacatacttggaaaactcattctattagaaattaaattatactaatactattgacaatcacttttatagttgtcattgcaaactcaaagacaagaagtaaattcatcaccagaaaacataaaacaagtacttagccttactgctgagaagcctgtaattgcattttactgaatggcacctcagttcttgggataaaatttgaaacggcaactggaaggacagctttaactttaaaatggttttatttttagggttgtcatgttgtaaaagctattctcacatagctaagctgttggaaagagaccaggttttgtgaaagtttttcatcagatgtttcacgttgtcctcactgcaacctcaaacagtggcaaatgctttgtaagctgctgtaatgcaaactcagctgataaattaataaaattctgtttctttaggccgggcacggtgactcacatctgtaatcccagcactttgggaggccgaggcgggcggatcacgagatcaggagattgagaccattgtggctaacacggtgaaaccccatctgtactaaaaatacaaaacattagccgggcgtggtggcatgcatctgtaatcccagctacttgggaggctgaggcaggagaatcgcttgaacctgggaggcagaggttgcagtgagccaagattgcacaactgcactccagcctgggggacagagagactccgtctcaaaaaaataataatgaaaaatgaataaataaaattaaaaaaataaaattctccttctttaatgtcctaagccagaaaatatttgttaacattgctaacaggaatgaatggacgtgaatggaccacccaaagattctcctatttcagggtcaacttcaaagagaaaacatcaatttcacagtgtttcttgcttacccaggtcaagagttaccaatatcaagacatccaactgcacagagattggacctagagcagcaggagggcgtatacaaatcacagataccagacggaattgcgagagggagcagaaaaatgattcatctgtatcaggtgtggtctgcaagttgtaggatgtagaatatagcttgtggataaagagaattagaaaaaattaatgcccattcaagtttattttatgaactagccaaaagtcgcacatggatattcacagtaggtagaatgattagagcagaagtagcacttttggcacatagttattgggattgaaggggaattcattttagctttaactttaaaatagatttaattacttttattttaattaattattctaaagcttttaattttaaaaaagtttgtaatttttattttggcaaaatatacatagcataaaatttgccattttaaccatttttaagtgcatagttcagtgtcactaaatacagtcacctgattgtacaaccatcaccaccatccatcatctctagaagtttttctttttcagtttcccaaactgaaactctgcattctttaaacaatagcccttccttaatctcttttcccattaactgggaaccttcattctacttttggtttctatgaatattacatgctacatacctcatataagtggaatcaggcagtattagttttttgtatccagcttctttcacttagcattatgtcaaaatccatccatgctgtagcatgcgtccaaatgtccctttttaatgctaagtaatattccactgtatatctgtaccacattttgtttatccattcctctgtcaatgaatgcttccaccttttggctatcatgaataatgttactatgcacatgaatttgcaaatatctgttgaagtccctgctttcaattcttgtgggtttaaacccagaagtggacttgctgactcatatggtaattctatgtttcatttttatttatttatttatttatttatttatttatttatttatttgagatggagtctggctctgtcacccaggctggagtgcagtcgtgtgatctcagctcactgcgaccccccacctcccaggttcaagggattctgctgcctcagcctcctgagtagctgggattataggcacacagcaccacacccagctaatttttgtatttttagttgagatggggtttcaccatgttggtcaggctgatcttgaactcctgacctcgtgatctggccacctcgttgtcctaaagtgctgggattacaggcatgagccactgagcccagcctatgttccatttttttaaaatttaggaactgctgtactcttttccaccatgactataccactgtagagtccaccggtaatgcacaagagtttcgatttggctacatcctcaccaacacttattattccctggttttttgatgattgccatcttaatgggtatgaagtgctatcttattatggttttgatttgcttttccttagtaatcagtgatgttgagcatctttcatgggcttgatggccagttgtatatcttttttgggaaaatttctatgtaagtcctttgcctattttttaattgggttgtttatttattgctgagttgtaggagttctttatatattctggatattggtcccttatcaaagatattatttaaaatattttcttccattctgccggttgtcctctgattgcacaaaagttttaaattttgatgaagtccaatttacttatttttttgttttgttacttatgcttttggtgtcagaaagcttttagtttataattttaaatatattacgtctcctgcctcataagtaccactggacaaggtcccttttatgtactcagcttctgtcagaggtaaatgtattttgaagtggaggacaaagataattgcacaattggcatggagaactaaggtaattatgaaagttccagatacaaagagagagagctcaatatgccagcagttctctaccaatccatcctagaggtcttctcttgggattgcctaaataatgcaggggatggttgcaagatacacaagtgttccagaagcgtgtaaacaaggtacagagaaaaggatgagataaaataagatgatataagatattaggaaagccttgttcagaagattgcctacagaggcaaaagggacagtttcattttgctgagggaaacagggtggtaagaacacttgtggggaagacccccacttaccctgatacagagagaagctgtaaaataacttaatgggagagcattaggctgagatagttcccatggcctgggttcctacataggcaaaatgaaaagcttagcccatcaacaagtggcccgctgagtattagctgtgtaatgagagacctaccaccaggatacttcaaataatgcaactgcccaaatttttgccaatcaaataatttctctactctacttctatattcaccctataaaagccttccctacaaacacctccagtagatcctccaaccactttcagtttggagctgcctgatccatgaatctctgtttgctcaaataaactctttaaaaatttaatatgcttaagtttatctatttttttctcatttttaaaaattgaaatgggatcttcctgtgttgttcagcctggtcttaaactcctgaactcaagggattcacctgtctcagcctcctgagtagctggaattatagacgtgtgcctccacacccagcttacatttatctttaaacaagggtttgacccctttctgaaatatatttgtgtgaagacctgtaccctcagtgatatggcaagctcattttagaccatcgagcacttttgtctctggaccacaatttgccctttgtgacctgctctcctaaaaaattcaagtgtaattcaagttagtttaccctctgctgatcaggggaggttgatctaggtgcaagttcaagacaggcactcactccttcattcataccccaaatctcagcatcacacaatacacccatgtaataaacctgcacaggtaccctccagaatctaaaatgaaagttgaaattcattaaaattgtaatttcatcttattaaaaaacaaagataaatttgcttctttccaattttgatatatattatactgacatacacactgtattctatggtgaattatatcgattgaatttcacattttaaactaacactgagttactttgagaaactctgttgggtcataatgtgttatgtttttaatatattttaatacaatttgcaaaaattctgttttaaaattacatctatgttccataaataaataaatatgtaaaaaataataaatgtttatattattcaagtgaagattatagcgatctttttgaatatctacttaacctcagctagctttaaattcagaagtagcaactccatagaaattcaacttatttctaccttattactcatacttgtctccttgaagaagcttcattgctgtcatccagtttagactgggatgtcataaatctctagactgagtagtataatattcactattaaaataaaatcaaattattattataatgttatgacacctccaaatacaaaaagcaagcccatggatgttaggttaaggtatagagacaagtattcctacttactatcttttagggcagacatatcccagccaaggtgattgcaaaatgaaatggaaactatatggtggaaggggacttgagactcacacagattggattttcattccaaccctcacatacacaagctgcatgactctgggttgattgcatattctcttagattttcaatttcttcgtctgtacaatggaggttaatgcctatgggctacggctgatgtggggataaaagaaccaacagggatgcatgggcagggcctggtccatggagcagctggcatcaacaaatggaagctccttcccatcttgtatttgtgtgcactacaaaatccggaatatgtgggtataaaaagtacctttataagagacataattggaaacttttgcaaaaagagtttggaaaggtgtcacatcttgtggcatgaggagttgtgggcatacacttgaactttgtgctgtgagatatccacagaacttcagtagcttaagagaacagtttagatgtcatcttattcatctaccatagaacttcctctttttttctgagatttctagacaataacttttacagctctaataatgcagttctctcccagttgtttggactattctaatagatacaaagcagtatttcaccagcagatgctactgcagtttgtatgatgatttcaaactaagaatccatttaaagttatgcaatacttttttggaaatagagtgaaagtactttaagtttaaaatcctataaaataggtttacagtaaataattatctgttgcaatgtctatcatactatcttatattcacacatgtgttggtgtcctaatacatatgtatgagagtgaaagttacctgaggtcagagactctgccatatgttccctgcaccactgttgcctatctcagcacatgatatacagtagatgctcaataaatactttaacttaaaaaatgcactaagaataaatcttattagacatcaaaatatgtacgagtacaatctagggacatggtcaggggctcaaaattcaatcttatttatttatttacttatttatttgtttatttggagacagagtctcactctgtcacccaggctggagtgcagtggcacgatcttggcttactgcaaccttcgtctccccggttcaagcgattctcctgcctcattctccagagtagctgggattacaggtgcacaccaacacacctggctatttttttttcgtatttttaatagacagagggtttcaccattttggccaggctggtctcaaactcctgagctcaggcagtctgcccacctttgtctcccaaaatgctgggattacaggtgtcagccaccacacagccacaaaatgttttaaagtagcttcaaaagccctttgcaaataggtgttttcataacaagatgaaaacaagaaaacattgagcttcatataatagaagggttctgcctggatttgcatgtggccccatcatttgtttgctgttgggccatggtcaggttacttagctgctctctgcctccacataggctttatgcctgtgcatccttcatctacaaaatgggaataataagaacatctaacaattagaagtggagaaaatatatgtaaaggtctttgaaaagagcttgtcaaagctcaataattgtcagctatcattcaataataatcataatcataaaaatatatgactcaaagaaagattgctacctcatatccagcttccccaaagaatatcagacattggacctgtgaaaggaatgacattgagatgtattttcacatcgctaagttggttttttctctttgccattcaatttctgcagtccccactctaagtccatggtccacctttttatttttcctcctaaaatgtcttcacttcttgtaaaatttacttttccttaaaaagggcccttttcatcctctcactcttttgcccttcccagaagttggttaatgggcccaaaaatacagttagatggaaagaacagaagaatttctagtgttcaatagcacagtagggtgatgatcattaacaataacttatatatttcaaaatgactagaggaaagatgtggaatgttctcaacacaaataaatgataaatgtttgaggtgatggatatgcaaattatcctgatttgatcactacatattgtatgcatgtatcaaaatatcacatgtaccctagaaatatgtatcattgtcatgtatcaataaaaacagaaaggcctatttctctttccttcctccccgcattccctgctgccccagatatgtgttgttcctggtgctctcctaccccacgttcagtcagcactgagccagcaggaaggatctcacagatcatatcctgagatcaaccctttcaggtaataatcctcctgcttttagtcatttatatcctttggttcgtatatattttgagtcaaatgccttctaactactgacttacataatatcccttggtttttaaagataatacaaagtggattttagtaacaatcttgagtcgtcacagaagctaatgaagttggggatgccatgaagccatccaagcatatagagcccatttccctgggtcccttttccttagctcaaggccacaaaaaatcagaacttgaattccagcccacatttgcattatgtctaaataactatgagttataaatgaagctaacagttaaatatattctattctcctacttcgataaatataccgccataattacccacaacgtcaaagtcgagtgtagaattctctgatttcttggtgctctgcacgggaatgtggtagtaaagggagagctgatcctcagccccaagctaaacttttttctttcatcgtagctagccctgtactctcttgagaagccttgtgtacccctgtatgggggactccctaggccccatgcaagctccatccacaattctcaccccttcagacagcagagccttgggcaccatttggacaagcacagtttgcgctttgaaatggacccagagaagaggccatgcaggctcagacacatttggccaggagcctgagtccccagtgtgtgccctagaagagagggtgagagctctgggtgggccagggtacagtcagtggagggccagagaggcaccttctcaagcgcaggattcagggcaggagtcctcttgcccagatggaaggctatgactgcttagtgcaatggcgcctgcgtcatgtcttctcagttcacctttcattcagtctctgccaccgtgggaagttccatggaagcgcaggcttcccttgtgctgccagccaactcaaactacactttctgccttagggcatctccattattgtaggatttttcctgagcacaaatacagcccagaaacacttgcaggttaacagcctcaggggaagacctcaaccagtgtgggacaggtgggcaaatgctccaggctcatgtttcaggtggacagttctggataactttctggagcctctcagaaggtcctgcagaaaaaactgcatggcaggagcctcaatagcaagccattattttgacttttctttcttgcctgtctcactcttcccacttctgactcctgcttcttggaatcacttcccaaataaaccacccacacccaagtccttactccagctctgcttttagggatacagacacaccttggagatattacacgttctaggtaaccacaatagggcgaatatcacaacagtgcaagtcacacgaaattttttgcaagtcacacaaaattttttgctttctggtgcatataaaagttatgttgccaggcatggcggctcatgcctgtaatcccagcacattgggaggccgaggtgtgtgcatcacctgaggtcagaagttcgagaccagcctgaccaacatggtgaaaccctgtgcctaccataaatacaaaaatggtggtgcgtgcctgtagtcccagctactcaggaggctgaggcaggagaattgtttgaacctgggaggcagagtttgcagtgagccaagattgcaccactgcactccgacctgggaaacagagccagacaccgtctcaaaaaaaagttatgtttaaactactgtagtcaattaagtgtgcaatagcattatgtctaaaatacaatgtatataccttactttgaaaatatgtgattgccaaaaaatgctaaccatcatctgggccttcagcaagtcatcattttgctgctggatggtcttgcctcaatgttgatagctactgactgatcggggtggtggttgctgagggctggagagggagtggcgatttcttaaaataagatgacaatgaagtttgcgcattgactgactctttctttcacaaaagatttcactgtagcatgctatgcagtttggtagcattttacccacagtagaatttatatcaaaattgcaaccaatcctctcaaaccctgccactcctctatcaactaagtttatggaatattctaagtcctttgttgttctttccacaatgttcacagcatcttcaccaggagtagattccatcccaagaaaccaatttctttgctcattcataacaagcaataataatacattattttatacataatatatataattatataatatacatattatatatttattatattatatattataatatatataatatgctataatatataatatgtaatataatataagcaaaaataatatcgcttggtttttaaagataatacaaagtggattttagtaacaatcttgagtcatcatagaagctaaagaatttggggattccatgaagccatccaagcatataaagcctattcccctgggtcgcttttccttagctcaaggccacaaaaaatcagaacaagaattccagcccacatttgcattatgtccaaataattatgagttataaatgaagctaacaaatagttaaatatgttctattctcctacttcaataaatatactgccataataacccacaaggccaaagtcgagtgtagaattctgattccttggtgctctgcacaggaatgtggtagtaaagggagagccgatcctgagccccaggctaaacttttttccatctaattccatttatttccattaagattgcagcaattcggccaggcacggtggttcatgcctgtaatcccaggctgaggcggacggatcatctgaggttgggagttcaagaccagactaaccaacatggtgaaacaccatgtctactaaaaatagagaattagccagatgtggtggcacatgcctataatgccagctactcaggaggctgagacaggagaatcacttgaacccaggaggcggaggttgtggtgagctgagatcatgccattgcactccagcctgggcaacaagagcaaaactccatctcaaaaaaaaaaaaaaaaaaaagattgcagcagttcactcacatcttcaggctccacttgtaattctagttctcttgctatcttcaccacaactgtggttacttcctctgctaaggtcttgaacccctcaaagtcatttatgagggtcagaatcaacttcttacaaactcctattaatgctgctatttttacctcctctggtgaatcataaatgttcttagtggcatctaccatagtgaatcctttccagaaggtttccaattgactttgcccagatccatcaaaggaatcatgacctatggcagtaacagccttataaaatatatttctcaaataataagacttgaaagtcaaaatgatgcctcaatccattgactacagaatagatgttgtgttggcaggcatgaaaccagcatgcgtttccctgtacatctccattagagctctttagtcaccaggtacattgtcaaaaagctgaagtatttgaaatgaatcttttttctgagctgtaggtctcaacagtgggattaaaatactcagtaacccatgtggtaaacagctctgatatcatccaagtgttgttgttccatttatagagcacaggtagagtagatttagcgtaattcttaagaggtgtcctaggatttatggaatggcaaataagcattggcttgtaacaagaaagtcagcctgtcctttaaatcttttttatttttcttgagataatgtctcactccattgcccaggctggattgcagtggcatgatcttggcccactccagacttgacctccttggctccacaatcctcccgcctcagcctcctgagtagctgggactagtagcatgcaccaccatacatggcttatttttatttatttattttgttagagacagggttcaccatgttgcccaggctggtctcaaactcctaagctcaagccattctcccacttcagcctcccagagtgctgggattacaggcatgatccaccctgcatggcctctaaattcgtgttatggagactcattttcatggttaaaatatcctgaattgactgtggcctgttgggaggtgggatggagggagctacttaaggaaaatgaaaaagaaagggaagcacaccagaagcaagaaagtgtcatcaatttttacatcaaggactccatgataaagagaaagtacaggtggcctgttatcatggctgaccattggactgtggactgcacctgcatctaccaggttcttctggataatcccagttttaaatttttgacctgatattcatgaacacagtgctactggtcagacctttgtccaggtttaagcttcagaacataatgtcttcatgcagtgggaggcctggttagggttatgattctgccctgggacatctgccccttctgacctggaggtaaatttgtcatctactatttacctccacacttgaacagccaatgatgggctgagcacagaggctcacatctgtaactctagcactttgggaagccaaggcaggaggatcgcttgaggccagtagttcaagaccagcatgggtaatatagtgagacctggtctctgtaaaaacaaacaaacaaacaaaaccaaggatggtgggtggcagggagcagttcaacatgggaaaccattaacctgagagctagaaggacccttaggccagcccccattaatagatgagactctgccctgagattatagtccaaggtaatgcattgagcttttctagaaatttgaaaataatcaatcctaaaacccccaagcatactgctattgtttgctattgaataatgttttctagtctgggtgtggtggcacctgcctgtaatcccaacactttggaagatccaggcaagtggatcacctgaggtcaggagttcgagatcagcctggccaacatggtgaatccccgtctctacaaaattacaaaaaattagcaagccatggtggtgcatgctggtaatcccagcttcttgggaggctgaggcaggagaatcctttgaacctgggaggcagaggttgcagtgagatgagatcatgccattgcactccagcctggactacagagacaaattccatctcaaaaataataataataatgttttctacaagcaaggggttactttatactgggaactggtgtgaagggattcaccatgtgtaagcttttggattgatgacagttatttctagatcatggaggtgggaatgcttgttgatcatcttctatgttctttgttatattgattgattttttaaattagcatttttataacaataaagtcataaaaacaagtaactaaaataaagtaaaataatctaaaaaggccaagcatggtggctcatgactgtaatccaagcactttgggaggctgaggtgggtggatcacctgaggtcaggagtttgagaccagcctggccaacatggtgaaacctcatctctactgaaaatacaaaaactagccgggtgtggtggcaggcacctgtaatcccagctactcgggaggttgaggcaggagaatcacttgaacccaggagaagctgcttgcagtgagctgagattgcaccattgcactccagcctgggtgacaagagctaaactctgtctcaaaacaaaacaaaacaaaacaaaaatctaaatgtaattgagttgaatatttaaacttttaactgacatttcaaattagattctaattccatttaaaagagcatctcatagaagcaaatgtactcaattatattaactctgtggtttcatttaagcaatttgttttgtgaagggacacaaatccaaccagattttaacagtgtataaatatgtatttattaatttaattacaatgacaatactctcaactccccatttgaataaaggagagcgtgtgatctgtgttctgagacagtgtgcactataggtgtgtggaaataccgatgccctcagctgtgtggtaggctcagtgggacctggagtgcaggagcccctgggccattcacctctggccacaaaagtcattgctcatttacacccaacttctatagaaatattattttcagtggttgttatgatgcaaaagaaaagaagcagggagatttattaaactgttacatataagttatgttagtaaataaagtctactttcttctggcttaactaaaaatctatactagtatttatgtcttttggaaattagagatgccaatttaagtattatgaagcaaagcaactgattattaggtaagacagccaagtacaactgcagaattgtagaggttatgggttacatgtataagaatatttcatagcaaaaatcttttaagactctgtgaagacactccacagtgaagcagaaattagaacagaattaataatactgtgtatgctctcagttcaccaatttatcaaaactagctttatgattcagaagggtgtctgcacttttgcaattggaagaaaagaaagaatattttattttttgactctttagattttcttcactaacagtatttccaaggctaagtaagggagttgcaagtaacaccaagagaaaaaagcagtcttgagcagctttttaaaaatagtcttaaaatatggaaaatgaagccaggtgtggtggctcactcttgtgatcccaacactttgggagcctgaagtgggagggttgcttgaggacaaaagtttgagacaagcctgggtagcatagcaagatccccatcattgcaaaaaataataattttaaaaaaaattatctggatgtggtggtgcatgccttagagtcccagttacttgggaggatgaggtaggaggagctcttgagcctaggagttcaagtctgcagtgagctatgattgcaccacagtcctcaagcctgggcaacaaagtgagactctctctctctctctctctctttatatatatttatatatatataatatgtggaacccatatatatatggaaaagggaaggggccaagaatatcaaagacattattgaagaagaggaaagattcgtcctgccaaatatcagaacttttataaagctacaacaattaagacagtgtggtcttcactgataaactgactaatgaaacagaatagagagctcccaagcaaatctccacaaatttaatcttcgatatgtgatgtaggtgacatggcagatcagcaaggaaagaaaggacttttcaataaataggatagaaaaataatggttattgatgtaggaaacaaaatgaaattatattcctacttcactctatatacaaacattaaattccagatggacagaagacttacatgtcagaaacaaaactttaaaacttttagtagaaaatgtaagtgaatgagacacaaaaagccacttaacaattaaaaaagattagacattttgactatcacaaaattaagaactttttacatcaaaattggaaagatagtctgggcatggtgtctcaaacctgtaatcccaacagtagatcacctgaggtcaggagtttgaaaccaggctggccaacatggtggaacctcatctctactaaaaatacaagaaattagccaggcattagtggcagacacctgtaatctcagctacttgggaagctgaggcacaagaatcgtctgaacccgggaggtggaggttgcagtgagccactgcactccagcctgaataacagagtaagactctgtctcaaaaaaaaaaaaaaatagaaattaaaaaataaaagtaaaaaagtgaaaagataaactataaattagaagaagttatttgcagtacctaaaacctacaaaaggttaatatcatatcaactaagtgctcatatgaattatttttgaataaggagctcctatgaattaattttaaaaatagcaaaccaacagaaaattgggaaaaggcattaatagggatttcacaaaagagaaagcccacaaaatataaaaattttctcaacctcattagtaatcagaaaaatgcccaagatactacacatctattctctccacaaatattgagaagtttgatgataccaaatgtattagtccatattcacactgctgataaagacatacctgagatggggaagaaaaagaggcttaattggtttaagggctccacatggctgaggaagcctcagagttatggtggtggatgaacagcacttcttacatggcagtgacaagagaatatgagaaggaagcaaaataagcaaaaaacccatcagatcttgtgagatttattcactatcacaagaatagcatgggaaagactggccccaaagattcaactacctccccctgggtccctccccgaacacatgggcatcctgagcaatacaattcaagttgagacttgggtagggacatagccaaaccatattattctgcccctggcccctccaaatctcatgtcctcacatttcaaaacctatcatgccttcccaacagtcccccaaagtcttaactcatttcagcattaacccaaatgtctgctgtccaaagtctcatctgaaacaaggcaagtctcttctgcttatgaccctgtaaaatccaaatcaagctagttacttcctagatacaatgggggtacagatagttgagaaaatacagctgttccaaatgggagtaattgtccaaaacaaaggggttacaggccctgtgcaagcccaaaatccagcaaggtagttaaattttaaagctccaaaatgatctcctttgactccatgtttcacatcaaggtcatgctgatgcaagaggtgggctcccacagccttgggtagttctgcccctgtggctttgcagggtataacccacctcctggctgttttcatgggctgatgtcgagtgtccgcagctttcccaggctcatggtgcaagttgtcagtgaatctacaattctggggtctggaggagtgtggccctctcctcaaagctccacgaggaagtaccccagtagggactctgtgtaggggcttcaaccccacatttcctttctgcacagccctagcagaggttctccatcagagcatcacccctgcagcaaatttttgtttggacatccaggtgttttcatacatcctctgaaatctaggtggaggtttccaaacctcaattcttgacttctatgcatgtgcagactcagcacaacgtggaagctaccaaggcttggtgcttgcactctcaaggccatggcctgagttctatgttggcccctttcagccatggttggaggggctgaaacacagagaaacaaggctctatgctacacacagcacagggaacccggcccagcccagaaaaccattttttcctcctaggcctccaggcttgtgatgggaggggctgctgtgatgacctgtgacatctcctgtagacattttccccattgttttggggattaacattcagcttctcgttacttatgcaaatttctgccaacagctggaatttatcctcagaaaatgggattttcttctctatcacattgtcaggctgcaaattttccaaatttatatgctctgctttctttataaaactgaaggcctttaatatcacccaagtcacctctggaatgctttactgcttagaaatttcttccagcagataccctaaattatcactctcaagttcaaagttccacaaatctctagggcaggggcaaaatgctgccattctctttgctaaaacacaacaagagtcacctttgctccagttcacaacaagttcctcatctccatctgagactacctcagcctggaccttattgttcaaaacactatcagcatttttgtcaaagccattcagcaagtctctaggaggttccaaattttcccacattttccagtcttcttctgagccctccaaactcttccaacctctgcctgttaccaagtttcaaagtcgcttgcacattttttggatgtcttttcagcagcatcccactccactggtaccaatttactgtattagtctgttttcacactgctgaaaaagacatacccaagtctgagaagaaaaagaggtgtaaagaaaaagaactgtaattggatttacagtcccacatggtggaggaggcctcagagtcatggtaggaggtgaaaggcacttcttacatggcagcagcaagagaaaatgaggaggaagccaaagcagaaacccctgataaacccatcagatctcatgaggcttattcactatcacgagactagcacaggaaagactggcctccgtgattcaattacctcaccctgggtccctcccataacatgtgggaattctggagatagaattcaagctgagatttgggtgtggacacagccaaaccatatcaccaaatatggagagactgtggatcaacaagatcatctcaaactaatacaggaggtgagagtttaaattagaacaaccactttggaaagaaatttggattatcttataaatttgagcattctcatatgttatggcaaagtaattcctctaccataggccctggagaaactcttgcccatatgcaccagaagtagtaaaaaaataaatgctcatgtaatgccattcataatagcaaaaatctagaaataagccaaatgttcattaataggagaatgggtaaactgatagaagaatgggtaaataaattatacccttaaaaactaaataatatgtcatttaaggcaatcatatgtatgcaataaaacaatgtttttttaaaggaagggaatcctaaacataaattcagggtagtagttaccctcgggctgaagggtgaaaatcaggaaaaaggacagaggaggagcagatgttagggtcagaaccctagttcttgggttcataagtgattaccatattgttcaaatacatttactcagaggcccaggcacagacaaggatgaaataggagccaaggtatgctatgagccaaggattatgattaatccaattttgtgcactttaagccatttgaaaaacagaaaagcaaaacaacaaaataatttttaagaaattgaatatagggtgttttgctctgaatgtgtccccctaaaattaatcaccaatgtcataggattaggaagtagagcttttaggtagtgattccttcatgaagggagagtcttcacgaatgagtttaggatccttacacaaggattggagggagtgggcttcccctgttttgcccttctgccttctgccatgtgaggacacagtgcatctcctcctgaagacacagtgcagaagataccatcttggatgtagagaccaggccctcaccagacaccaatcctgctggcaccttgatcttggacttctagcttatggaactgtgagaaatacatttctgttcttcagaaattacccagcctagtgtattttttatatagtagcagaaactcattaaggcataatgcctcttgtcattttcttctacaattttctttgctgcctctttagcactggggcattttatatttgatccttcatcatatctcttacttttggtttttcacatttctgttccaagtgtattcttagacacatattttccaatatttgttagcatccaggtcagaaagtccagaataccttcttttaaggcttccgtttctgcaacaatgaagtattaacgcctcctgtaaactaggtatttcctttccaattgtaactgccatctggaggcaaagtagaattctagtctatgagtgtggggttgatttttaatgtatctagagtatggtaaaatgctggtttttaatcacacagatacattgattgcttggcacactagggtaccagttgctagttatctctgtattgatccatgctgttacagagggaaagtacagaccatgaagttggaccagctgtcatacccacaacatttggggagctttgattttttttaacctttagctgcttaactgtcacatctagaagctcaggtgaaaagcacccttattgtggggactttcccttagtgctctgtggcactaaagagcagacctatgtagaagcatttaagtattttgtgcatcaacaggaaaattaaaggaacaaattcttattgtatcctttagtccctgacgacaaaaccacagtgacagtaactaggtcatggcattgtattcagagagggtcagccttggtatttgacagtgagtcccctgtaccccactgtcaagactcactgagcagacgggaaagttcaggtggaacatgcagtaaagagcaaacacggtggggggcgctcactgtcatacactgccatgcctgccatggtcagcagacctgtcttctatttgacaacaggcaagttgagaaacatttttttggagagtttcttgattcttcccagttgtggcaggatggactgacttagaggagctcaggaaggttgttaaacaacacagaaacgcaacatgaattgtactcctcagcaggcctatgttagagcagcaggtccttgaagcctcagccactcctgggacacagcataatgcccctaatgatttcaaatttggtggagagtgggctgctaatcccagtgtccagggacaaaaagagacataaacagcaaaaagttataaaataagtgggcctaacatctgcttattgtgggaggtagggatttaaggtataagaatttagctgcatgtggaagctcacacctgtaatctcagcacttgaggaggtcaacgcaggaggacagcttgagcccaggagtttgacaagagccaggaaacatactaagtccgcattcgttcaaaaatgttttgaagaaaagtagttgagtgtggggacacatgcctgtagtcctaggtacgtgggagcctgagacaagaaaattgcttaagcttgggagattgacactgcaatgagctgtgatcacaacaatgcacgccagcctgtgagtccggagacccgaaccagcacccttaagcagggtccacctccacctgtagaaatcggcccaaggaggtcctgaggaaaggactcccgggagtccggctctggggggcccgaagccccactcccacaacgccccctactacatcccagctcaagcaaacaccgtgactgccacaaaaacccccgaccacacatcgcaaaacctgtttaaaggagccacagccggactttgaagagcaaagcccgactccgcatgggaaatgcaaatgcgcgaggcgccagcccattctccagtcacagtgactccaacagttggctgaggaccactccttaaaccttatcaaagcaagagcactttcggacagtgcgtcggcgttgaggatctagcatgaccaacccagggggtcgaaaaaacagtttcaggacaccacgatacactgagggctaaccaggaagcagaaagaacagacggagtcctgtgaaagaagcgcaacatcccagactcaggcctgcccggacggtgttcgggtgagtctccccagaagtcgtgcccccgagatctcgaggacaggactgccagcgtgcccgggggctattcgctcacacaagtttcgttcccgacgagagcagaacccggcagccacaggggttgcctgggggccagtatttctatgccacccctgtaggactgtgggtgggggtgtccaccgtgactggatgtgtcttctaggaaacgacagtcttgaagaggaagccgggaatgggagatggcaacaatccccgtccctggaacgccggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacagcaggccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgagccgcgcgccgctttttgcttcacagtgcttcccacggttgtcttaggaaccagtccccgaggcttggcaacacaggagccctccgtggcagcgcttgggtgtcgggcctccgaggctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccacaggggttgcctgggggcgtgcattgctcggccaccgcggtaggactgtgtgtggggctgtgtctcccattctcccttctctctctgtctctcaccctctgtgtgcttctttccctctgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttccactttgggtctgtgcaggcctcgataacgtgaggggatgcatcgggcccggagcagtggaagtctcatccccatcctgagcggcctcttttctaggatcgagaggaccacactgcagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccgtccctggaacgctggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacaccagccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgaggcgcgcgccgctttttgcttcacagtgcttcccacggttgtcttaggaaccagtccccgaggcttggcaacgcgggagccctccgtggcagcgcctgggtgtcgggcctccgaggctccggcctgacctctccacggggtccacaggaacgtctccggctgccaggagtcgcaaggggccgagcaggatgaggaaaccacaggcggagtccaggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccgcaggggttgcctgggggcgtgtatttctcggccaccgcggtaggactgtgtgtggggctgtgtctcccattctcccttctctctctgtctctcaccctctgtgtgcttctttccctctgtgtgtgtgtgtgtgtgtgtgtgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttgcactttgggtctgtgcaggcctcgataacgtgaggggatgcatcgggcccggagcaatggaagtctcatccccatcctgagcggcctcttttctaggatcgagaggaccacactccagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccatccctggaacgctggccactctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttcgccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacagagggactgcgctgggactggggctggggctgcgtgcagtggaggttgtgtcagggctagctgggtggtggatggttgggggtggggtgactgttgcagaaacccctgttgtcctctggcaggcatttcaaaatgtggcttggactgaggcacaggccccgtccatgttcccaggtcttctttgagttcccttggcactcagggaaaggccagttgatccccctttccaccgggcacattcctggacagcaatgttggtttctcccttgccccatatgcctccggtgacatacattcacgccatctgctctggtatatgccagtgccaggcgtgaccgcattgtcaccacctggcattcgccccgtccctgtctgcacgtgtcctggaaagcggtatcggcttgcaggagccccagggctttcagaagcgggccagttcactgctgtttcaaaggaggagggaggcagagggctcacgattcagtgaattttccactgacagcaggccttgagggccatgggatcattctctgctgcagccaggccctgcctgcctcagcaaatgtggtgagcccctcctttctcacccggagtggtccaaaatggcatctgaagaggagtcctgagaacccagcaggcgccctgaagctccccgtccatcggcggaagttggctcaaggaggtcctgaatacgggattcctgggggctttgcccggggacacccgcggccccttgtcacaggcgccccgaaactgtaccccggatccagccgcagccgcggctgcgcaggcgcgccccctgccgccccgcacctgcggttatttaaagctgacacagcttgcctgagggccaggagcccatgcgagtcgacccagccaatgcgcatgctcgagtggctcgccgcttttcgcgtcatagtggttctcacggttgtcttaggaaccagtcccttggcaacgcgggacccctccgtggcagcgcttgggtgtcgggcctccgaggcttcggcctgacctctccacggggtccacaggaacgtctctggctgccaggagtcgcaaggggctgagcaggatgaggaaaccacaggcggagtccggtggaagcagcgtggcatcccagcctcaggcctgccaggacggtgttcgggtgagtctcccgagaagtcgtgcccccgtgatctcgaggacaggtccgcctgcgtgcccgagggctgttctgtcatcggagggtcgttcccgtcaggagcagaacccggcagccgcaggggttgcctgggggcatgtatttctcggccaccgcggtaggactgtgtgtgggggtgtgtctcccattctcccttctctctctgtctctcaccctctgtgtgcttcttttcctctgtgtgtgtgtgtgtgtgtgtgccagtgtgcgtgtgtgtctttgaacgaatgtgccttgtgcgtcagaaagggatttcttgcttgtctgccggtctttggtgggtttctttctgcgtctctccctgggtcctgtccagctgtccatcgttttcacggcggttccactttgggtttgcgaaatcctcgatcacgtgaggggatgcgtcggccgggagcaatggaagtctcatccccatcatgagcgtcctcttttctaggatcaagaggaccacactccagcccaggacaaatgccccacggtagcacattgtccggcaggagaggagcagacccacgtccaagaagatggttgtacctttccacgcctcttctctgcgaaatgaagccacagaacgacacaatcttgaagaggaagccgtgaatgggagactgcaacaatctgtgtccctggaatgctggcctctctggacaagccacgcacttcgcacccctcctgttatgcccgtggcggtggcacggcgctgtatcctacctgggctctggcctcctctctgtcctccctcttgctctgtctcccctgtttctgagcggcctaggtgcctcttggcctggctgaatatcttctacaaagatcacttcccagtccatcagggactctcttcctggaaatcggtgtcatgactgtttctctctccaaacctgtttctgctgggttggttaggtctggtgaccctggagctcttgtcttccatacgtgtctcagccagggaagcttcctcggtctccatgtttcacctcatttgtgggtggattttctagaattagttgtaggcgacagtgactggtcttgtcttctaggacaggagaggtgccgcatttcttctgcacttcctgtctcatcctttagggacatgctgtcctctgctcctgggtgtactgagtccctgaatcttttggccccctcctgcatcccaggtgttctttgattttccttcgcattgatggaaaggtcacttgtgccccgcttccgccggccacatgcctggacaccattttttgtttcgccatcgccccatacgccctcggtgacacacatttatgccatctgctctgcggtacaccatgccacgtatggtctcattggctccacctcggaatttcccctgtccctgtgttcacgtgtcctggaaagtggtatcagctttcaagtgcaccagggcttttcttttttcaaaggagaagggaggcatcagtgaattttcagctgacacctcgccttggggcccatgggatcattctgggatgcagcgaggccctgccttcctagcagatgtggtgagcccatcctttctcacccggaggggtccaaagtcggatctcaagaggagttctgggaccccagcaggcgcccagaagctccacctccaccccggaagtcggcttaaggaggtcctcaagaccggactcctgggggtttggccttgggacgcctgtggcctcctctcccacgctgccccgtactggacccctgatccagccaccgccagggctgcaatgcgagccgcccttcctctgcgtagccgctattgtttaaaggggtcgcagcctgactgccaggagcggagtgcgactcggcccctccaatgcgcatgcgcaaggccctggcgcatgctccagtcacagttattcccacggttgtcttagaaacccgtccctgaggcttggcaaagtaggagccctccgtggcagtgcttgggtgtcggggctccgaggctccggcctgacctctccacggggtcgacaggaacatctctggctgccaggagtcgcaaagggccgaccaggatgacgaaaccacaggcgaagtccgggggaagcggcatggcatgccagcctcaggcctgccaggacggtgttcgggtgagtctccccagaagtcgtgcccccgtgatctcaaggaccggtctgcttgcatgcctatgggctgctctctcacctgagggtcgttctcatgtggagcagaaccctgctgcctcagaggttgccttggggtgtggtgtgtttctgtgccagtgctgtatgactgtgtgtttttgtttctgtgtgtgtgtgtgtgtgtgtgtgtctcctattctctcctctctctctgtctcttactctttccctctctctgtcggtttgtttgtgtccttgtgcgtgtgtttgtttggacgaatgtgccttgtgcgccaaagaagctatttttgcatgtcgtctggtctttgttgagcctctttctgggtctctgcctgggtcatgtggccggctgtctatcgttttctcggcgtttccactttgggttcgtggagacctcgaccacgtgaggagatgcgtcagtcccggggcaattgaaatctcatccccatcctgagcagcctcttttctaggatcaatatgaccacactccagccaaggacaaaatgctcacaggaggtcatttttctgcaggggtggagccaaccaaagtcaaagaagattgttgtatcttttcacagctcttctctgagaacgaagccacacaacgatagaatcttgaagaagaagctaggaatgggagatggcaacaatccctgtcactggaacactggtctctctggacaagtcaccagtttggcacccctccccttatgcctgtaccgatggcatggtgctatatcctgcctgggctctggcctctgctctgtcctccctcttgctctgtctcccctgtttctgaggggccttgatgtttcttgatctgtctgaatgtcttcaacaaagaccacttcccagtcctccagggcgacacttcctggagatccgtgtcatgattgtttctccctccaaacctgtttctgcttgattagccagggttgatgatcctggggctcttggcttccatacgtatctcagacagggaagctagcttggtctccatgtttcacctcatgggtgagtggattgcctagaatgagcagtaggtgactgtgactggccttgtcttctagggcagggacatgtcgcatttcctctgcacttcctgtctcattcttgagaaacatcctcccctctgctcatgggtggactgactccttgaatcttttggctgtaatgaaagtcagggatccaatgggactgggctggggctggagctggatgcaggggaggttctgtcagggctacctgggcattggaggattgggggtggattgaactttgcataaacctctttactcctccagcaggcttttcaaaatgtggcttggactcatgcaataagaaatttaccggttgaaagggcccctttttcaatggcactctgggtaacatcgcttcagcacaatcatatggtagagaagccttatcaaatttgctgtccctcagggctcttaaagatgcttgataaattattagggaaataagaaacaaattgaaaggaaaaggaaatccaaggacctgccccagaagaatcatagatatgtttgaatacttattcattatttgccccagatagaaaatgtttgttaatcaaaaggcaaaagttataatgaggaagataatattgcctggggcaatgttgagacaaataaggtgaagatcaaccaaacgccctgagtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaatgtttttattttgagttatttatagtttagaaaaattgggtgaagtgtgtttttgtgagcaaatttatttttctctaggttatccgtaatttgaaagctgtgagtattctgattaggtgacaatatagttatttgcttaagtacatcttttattgtaaaatgggacaaatggagacactggttattttacccaggctttgactagaataacttaattttaggtaaatcccaacaaacccaacttaagaggagtctatatgaccaattaattgtttctgcactttaagcaaatactcaggctgtactagtcccttctcacactgctataaagatattacctgagactgggtaatttataaacaagagaggtttaactgacagttctgcatagccggggaggcctcagaaaacttacagttatgatagaaaggaaagtaggcaccttcttcaaaaggtggcaggagagactgtgtgtgtgtgtgtgtaaaggataaaatgtcaaacacttatacaatcatcagatttcataactcactatcatgaaaacagcatgggtgaaacaactcccatgatacaatcacctcccaccaggagggatgacaatttgaaatgagatttgggtgagcacacagagtcaagccatatcacaagccaaccataataagcctaaaacttatttttcacacaaattgttctcactatgacttctcctacagattgtttcaagggaaaagggtaatgcttgttactaaatgtcagctctggcttttattttattgagtacaaattgaatcataaaatttttttattttattttattttcctttaagttccagaatacatgtgcagaatgtgcaggtttgttaagtaggtatacacgtgccatggtagtttgctatacctattgacccatcctttaagttccctcccctcacccctcaccccccaacaggccctggtgtgtgcttttctgctccctgtgtccatgtgttctcattgttcaacttccacttatgagtgagaacatgtggtgtttggttttctgttcctgttttagtttgctaaggatgatggcttccagcttcatcaatgtccatgcaaagggcatgatctcattccttttatggctgcatagtattccatgatgtatatgtactacattttgtttatccagtctatccttgatgggcatttggactagttccatgactttgctattgtaaatagtgctgcaataaacatatgtgtgcatgtgtctttagagtagaataatttatattattttgggtatatatccagtaatggggctgctgggtcaaatggtatttctggttttagatccttgaggaatcgtcatactgtcttccacaatggttgaactaatttacatgcccaccaacagtgtaaaagcattcctatttctccacagcctggtcagcttctactgtttcttgattttttaataactgccatccgactggtgttagatggtatctcattgtagttttgatttgcatttctcaaataatcagtgatgttgagctttttttatatatttgttggccatgtaaatatcttctttggagaagtgtctgttcatgttctttgctcattttttgattgggttatttgtttttttcttgtgaatttgtttaatttccttgtcaattctggctattagacctttgtcagatgggtagattgcaaaatttttctcccattctgttgtttgcctattcactctgatgatagtttcttttgctgtgcagaagctctttagtttacttagatctcatttgtcaatcttggcttctgttgcagttgcttttggcatttttgtcatgaagtctttgctcatgcctatgtcctgaatggtattgcccaggttttcttctagtgtttttatggtttggggcttgacatttaagtcttatgtttaaggtttaaagtcttaagtttaaggtttaaggaagggttccagtttcagttttctgcatatggccagtgaattttcccagccctatttatcgaataggagattctttcttcattgcttctttttgtcaggtttgttgaagatcatatggatgtagatgtgtggtgttatttctgaggtctttgttctgtttcattagtgtatatgtctgttttggtacaagtaccatgctgtgttggttagtgtagccttgtagtatagtttgaagtagtgtgatgcctccaactttgttctttttgctattccaaacaattgaaaaggagtgacttccccctaactcattttatgaagccagcatcatcatgatagcagaatcaggaagacacacacacacacacacacacacacacacacacacttcaggccaatatccctgatgaacatcgatgcacaaatcctcaataaaatactagcaaaccgaattcagcggcatatcaaaacacttatctaccacaatcaagtcagcttcatccctgggatgcaagactgttccaccatgcacaaataaataaacataatccatcaacataaacagaaccaaagacaaaaaccacgtgattatctcaataggtgcagaaaaggcctttgataaaattccacaccacttcatgttaaaaactctcaataaactaggtattgatggaacatatctcaaaataataagagctatttatgacaaccctacagccaatatcacagtcaatgggcaaaagctgtaagcattgcctttgaaaactggtacaagacaaggaagccctctctcaccacttctattcaacatagtattggaagttctggcaagggcaatcaggcaagaggaagaaataaagggtattcatataggaagagaggaagtcaagttgcctctgattgcagatgatatgctgctatatttagaaaactccataatctcagccccaaaaccccttaaactgataagcaacttcagcaaagtctcatgatataaaatcaatgtccaaaaatcacaagcattcctttacaccaacaatagacaagtagagagacaaataatgaatgaactcccattcacaattgctaaaaaaatgaataaaatacctagaaatacagctaacaagggatgtgaaagacctcttcaaggagaactacaaaccactgctcaaggaaataagaggacatacacaaatggaaaaagattccatccccatggataggaaaaatcaatactataaaaatagccatattgcccaaagtaatttatagattcagtgctattcccatcaaactaccactgacattcttcacaaaattagaaaaatctactttaaatttcatacagaaccaaagaagaccccgtatagccaagatgatcctgagaatcctgaaagttttcatagttataataatcttctaatgagtacaggattatcatttttcttcatattttcagttggtgacctaatgaaatagcgtattttttctcttttgacacacaagtactcttctgatggtcaaaatagtaagttatttatctctccttgtttcacttcaaaggaaaccagaatcatggcattctgaaagttagagatgcaaatctccattatttggcatcccactggacccgatctgtttttcattgcaaatgtcctgctgctaagactatgcaaggaccctccctctaggcccagagactgttgcagaggagatgggtgcatgagattgtaagggctggttatgagggatacagttagctcagacactccaaatcaaggagggtacacaggtgcctaaacagcttgtaaaacaaagaactttgctttctcagctattatgtggcacctttttatccaccccaaccatgaaaaatgtcctgcttcctggaattaaaacaaaataattattaagaggataaagatacctcatgaccaagcctcctgggcataatactcccagttataagttttgcagatatatatatatttagatatataaaattattttttagaaaaatgtatatgttttgtatagttaatcactgtaagtctgtaatgaaaaccaagattatagtagctcaatgcatagaagtgaaagaaaagtcaatttttgtaaactcgccattggctttttgtttttggctctttactttaaatatatcttttaaggggtaatgaatgcctgtccgagtccattcctgtctttcctagaacgcttacttgtctataagtatttgacttcaagtccctccaccatagagagtctcactgaagggcaggatggacacagggcaggcagatatgccacccaagcagtgctaggggaaaaaaaataatagccattgatgctgatgctggcaaatattggccataaatggaagaatgtaagccaaaaataaaattctaagcccttcaaccatctgaatgtacccctcctctcggccataggaattccagattgaaactgaaaatcttgttcaggccatgatggaagagagcattggacatgcctcattatatttctctagcattaacatcaacacagaccttaagacatcaacatcagacctaagagtctgatcagaaatatttaacatctattttctctgaagcctgctacctggaggctttatctgcctgataatatctaggtttctccaactccttatcttaacccagacattcctttctactgataataactctttcaaccaattgccaatcagaaaattttaaaatctacctataacctggaagtccccacttcgagttgtcctgcacttccagactgaaacaatatataccttacatgtattgactgatgtctcatgtctccctaaaatgtgtaaaactaggctgtgccctgaccatcttgtgcacatgttctcagggtctcctgagggctgtgtcatggcccattggtcacttatatttggctcagaataaatctcttcaaatattttagagtttgactctttttgttgaccagtcactccctagtaagtttaggagcagggatctgacagcaaccatatcatgctcagaaacagcattctctcatccactgtccccaggctctgcagaacccagggtcctggtatccataacccaaggaaatgggaaggagtcatgagctcttgggctttctcattctctgaaaatggacaattgataactagccgtgattttgtttagaagtataaataaatgtcacatttctaagcaaaatcaagtctagtttcaaatgtgtgaaaggaaaatagaaacttgggaccccaattcactctgccaaaaggagaaagttaagctgaaagctgagtcatgtgagaagctgactttccttttgctcttaagcacacagctccagatagaaggtaaaatattcccacaggtaggtgctctgtcctcatcttaccttatgtgaagtgctgatttactgagcataagatgaataccaaattgactattcccctgccttatccttttcttttgcaatgtgtggattcagtaatgtgaccatacccttcctctttcccctccagcaaactcttcccctttaagtattgaagcctcagcatcatttttggaaaaaggcacagaccacagattgtttctattattctgtgttttttccttccaacttgtccttaatcttggcaaaataaacttctaaattgattgatacctgtctcagatacttactcgtttatgaatattagaagcagtttgtgttctcgtcgtatgtgttattacagctatccctttttatccaaccttttactatcaagctcaataatctaataaaatcagataactttttaggtgagtccctttctatataaactcttgctattcatactggagctacattcatttggatagtgctctccctcctgagtcaagcttggtgcctgactctccctatccaaatcagaagccaaatagacttggaaggttcaggcagtcagtgtacacagaacacacacgaccttttcgtttagccatcgctagttatctctagtaggtgtaataaggagaaatgtttacttttcaaatacattgctgtggtgttttaatttttacaagcatgtttacataactaatttttataaaatacacctgttgctggatacctcttgttcctatcttgataaccatcaccgagatttgcaaaggaggccttgctcaaatatttggaaactaatgccctcagggagatgtccaccagccttgttcctctcattcctatttaaagattgtaatgtcattgggtctttccctagggtggcccctggttttccaggctggacactcctgtgttgaagatgcatcgactcacgtactgcattaatgttttagattttactgtgaagcaaacaattcactcctcagaccctcagtcacccaagtccacatctggacttgaggtttggcttctctggtcctaactgggacttatctgaccctgacaggagataacttcagtagggactttccctaatagcaaacatgcacacttcaacttggcttgccctgaaggtaacatttactcattataatggtaaaaaaaaaacacacccctgggtggagatttcagacattactaagacgtgtgatatatgtactagcgtgtatgaccatacagcatgtgcacccaggagaccacccaaaacatgtttgctagtaacaccccttcacaacccctttcatgaataatcatataagaccctcataagggagcttccccagtgccgatcaacgctgtttctttttccaagcagcccgctctgacttggcttttagagggtactctctctttaaataaactctgcagctgcttcactgtcactgattacttcttggctgaattctttccttcaagaagacaagaactgaagaccccacaccttccggtaacattaccaactctttctcctttttctctggagctggtgctcagatggtgagagccctgagctaatagtcccagggtgggagcctgtttgcccctgtctggtcctcagcaatgtccttggtcagcttcctggcaagagctgtcgattaccagagggaacaagtgatcagcaccagagtcgatcacttcacagaggagctgaagtggacagggtcagctcaggcctcacggactagggcgggaatgtcccgtgacggcaggtcagtgtcttagcttcctttgaggcacctcttcatagactgcagggatcatttaggtaagaatatagcctgctgacttttacaccttgctgaaaatctttgctaatagcaatctgttagctgtgaaaattaccattgttttttatttttcgttttgttccttattactgaagatattctatggagcgttaaagcctcctgcggtaagaaactagtaaagaaacatactgtttgcaggaaggaaaattacccacaattcttgttctctaaggtgcgtggttatcattccaacagccattctcagcaatgaactgaagaccctcagatgtgtttcattcccttagtattttaatcctctcctccactctcaattgccacttctcccgtgaatgaggggagaggggttgggagggacatctcctgtcttgggcccacagattttaaagttcaagtcagaagctccagtgatttcctgtatgtagtagtcaggggcaagacagatctgtggttggtagtctttccttctctgtacatctgccagcctctctcctcaagctggggcttcatggagtcccagaactttgaacctgaagtagtgtcagcagccatgttgcagctggagtcaggccaattgttggtcttgctccctcgtgactgggacacttggaagagccaaatgggcaggcttggagagcgtgtacttttggaactgaagtgtatcttaaaccatttcattgcaactacgtgtgtgtgttgggaggatgcataacagcctcactgaggggtgactgacatataatagaaggacttgtgcacccgtgaaaccatcactgttatcaagacagcgagcatgtccatcccccataggttttcttgtgctcctttgtgatcccttcctcctgcctctcctgccatgctccaccccaagcaaccactgatctgctttctgtcacaatatatagattggaaaactacttataataccagttctaacctcatcaagcaaatactttctttttgtcagttgaacttttcattgtgtgttcaacattcttgattcagaaagagtgagagagaaaggctggtgtgggcccttcctgggaggcctggccctatccacagctccagtgtggctcacgtgccctggagcccctgcccacaggacagtcctgactgctcatccacaagctttgtggtatcctctaccattcctaggcaggctctgtacagtgcagaactttctcccagtccttgcaccaaaataacaaatgtcagagatagtacatttggagccagtggctgtgcctcacctctagatgcctgtaatactgagctgctaagcaagaggtccctcccttcttgcccttttcttggggcctcatcccttgtgctctgctcttcctcacacaggatatatcttctgattgctcctctcccacctcctgcagtccctggacccccatggcaatacaaacagactcttctatatcctcagtccattgcaggaccacagctctgacctggctgtcctctgttttccaagccctgcacctgtggagttgggaattagcacccacttgaccccattgtggcatcaggcccaccctccccaatgcaggaagagttccagatgttggggagctatggcattatcctgcacacatatcatgtcctggcctgggaaagtgatgatgatgatattttcccacaaaatagacaataacatcatgaaagtgccttgttcattttctagcataaaatatatatcaaagcagtggggtttagtaggcatacgtagatttaaaagctcctcagaaggcagggaatgatttcttcaacagaaaaaaaaactaccccaaaaggagaatctcaatactttggttgatagtaaattaagaatccctcaagaaattcagtaggagagggaaaagataagtcaccaatgggaaatatatttgtcacaatataacaggcaaaggactcatgtccagagtgcatgaaggatttctacaaataaaataaagaatccaacagaaaaatgaagaagagaaaggaataggaacttcatttttaaaaaagagaaaagaaaaaggaagtaaggaaaaacaaatgaacatccaaatggccagaaagcatataaaaatgcccaacctcataaaccatcagacaaatgtgatccacaatgagaagccaatacacaccgaccagcacggctaaaattaagaagactgttaataccaagtgttggtgagaatgtgaagtaactgaaacatttatacactgctggtggaaatgtgaaatagcacaactactttggaaaattatttgggaatactgctaaaggtgagcacccctatgatcctgaaatcccactccaatatgaaaacccaaaagaaatgcatcctgatagaggcactcttcatagtagcccaatgttaatcatggaagaatggacaagtatatatcatatcatggaatttttatggtaatgaaaatagattaataactgccatgcacagttggtgaatcccaccaacataatgttgagtgaaagaaacctgatacaaatgaatgtatactacactatttcatttctgtgaagctccaaaataagcaaaacgaacctatagtgttataagtcagtagagtgattatcttagtatttgcatgggagctctggtaatgttttatttcttgatctaagggctggtgtcccagatgtgttcactttgtgataattcatcaatctgttttcttgggagctgtggcttatctgtgcagatatactccaattaaaaaaatcattcaactcaatgacaacaacaacaaaaaaaactcgattttttaacattttgtggagtgtttattatgatccagtcagcgtactaaatacactattttatttgatccttaaaataacttaaacaacttgatttaaatatgggcaaaggacttgagaagacatttctccaaagaagatatacaaaaagcacatggaaaacccttgacataattagtaatctgggaatgcaaatgtaaaccacggtgggataccacttcacacatgttagaatgactattatccaaaaataaaacaaacagaaaataacaagcattggcaaggatgtggagaaattgaaacccccatgcattgttggtgggaatgtaaaatggtgcagccgctgtggaaaacagtttgatggctcctcagaaaaccatacacagaattaacatatgatccagcattgccactttcaggtatatacccaaaacaatagcatgaaacacataaagagacatgttcatagcagtattattcagaataactaaaaggtggaagccatgttaagtgttcattgacagatgaatggataagcaaaatgtggtatatccatacaatgaaatattattcagcttttaaaaggaaggaaatttgatacatgcaacaacatggatgaatcttcaggacattgcgttcagtgaaataaaccagtcacaaaaagacaaatactacaagattgcaattacatggatacctagaacagtcaaattcatacagacagaaagtagaatggtggttgccatgtcccaaagccaacataaagcagcagttgtggacagcttcagtttcagctgaacttgactgtatgttgtgctgaaaccagggtaatctgatgtccaacactcagagccagttaagacttttgtttctggtgacctggggagctgacagtgcttttcaggcacacctggggtaactcttatttcccaaatgggttggcagattgttgtgggtgccaggtctttgatggactggatctagacacgaataaatagcctgctgggattttgattcggattgtagtcaatctatattgaatctgtgttttaagagtataacctcttaacaatattgagtcttctcactcatgaacaacatatatctccccatttatttatggcttctttaatttatcatagcaatgttttacagttttctgtgtacaggccttttacattttttgtcagatttgttcctaagtactttacattttgcatgctattgtaaatgttgttaatttttttattttaatttcttcattttttacttgacaaatacaaattttatctattcatagtgtacaatatgatattttgcaatatgtatacattttgggatggttaatccaaccaataatatatgcattacattttaattttcaattaagttacaaagctctcattaaacaatttttgtacactaatttgtcctgaaaccttgataaacacacttattaacttcttgtacattccactgaattttctacacagacagtcatgtcgtctgtgaataatgaccatttatgtctttctttccaaactgaatgtcctttatttctgtttcttggctgattgcacagtctacagcctccaatacagtgctggatagaggtggtgagggcaggcatccctagtgtgttcctgatgtgaaggggaaagtattcagtcttccacaatcaagtgtgatgctagctgaaggacttttggaattgccctttatcagcttgaggaagttccctctgttcctaatttgcctcagtttttatcaataatggatgttggattttgcaaaatgttttttctgtattgattatggtgatcatataattttttagtttgtttatgtggtaaattacattgatttatttttttactcttaaatcaaccttgcatttctaggataaataccacttaattatgatgtattacatttctattatatttaggattccatttgctaaacttttgcatagaattcttgccctatgttcatgaggattattggtctgtagttttgttttcttctaatatccttgtctggccagggtatcagggtaatgctgatttcatagattgagttgggaagtatttcctcctcttcagtttttggaagagtttgtgaagtcttgttattacttctcccttaaatgtttggtaaaattcactactatcaccatctgggcctgaatttctttatagggaggtttttatgttattctttttttttttttttgagacagtctccctctgtcacccaggctggagtgcagtggtgtgatctcagctcactgcagcctccacctcctgggttcaagtgattctcttgcctcagcctcccaagtagctggtattccaggctcatgccaccacgcctggctactttttgtatatttggtagacaagaggtttcactgtgttagccaggatggtctccatctcctgacctcatcctgacctcatgatccgcccacctcagcctcccaaattgctgggattacagggatgagccacggagccaggatttttttttttttttgagggagagtctcgctctgttgcccaggctggagtgcagaggtgtgacctcagctcactgcaacctcgggggaacccacccctgataattcaatgtgggtacttttctattttccctaagtgtcagccagtctgagaaataaagggaaagagtacaaaagagagaaattttaaagctgggtttccaagggagacatcacatgtcggcaggttccatgaggccccacaagccgcaaaagcagccagtttttattagtggttttcaaatggggagggagtgtatgaacagggtgtgggtcacagagatcacatgcttcacaaggtaataaaatatcacaaggcaaatggaggcagagtgagatcacaggactggggtgaaattaaaattgttaatgaagtttcgggcacgcattgtcattgataacatcttatcaggagacagggtttgagagcagataaccaggtctgaccaaaatttattaggcgggaatttcctcatcctaataagcctgggagtgctacaggagaccggggcttatttcatcccttatcgacgatcataaaaggcagatgttcacagagcggccatctcagagacctccccctaggaacacactctctttctcagggctgttcttcgctgagaaaaagaattcagtgatatttctcctctttgcttttgaaagaagagaaacatggctctgttccgcctggctctcaggcagccagacctaatggatatctcccttgttccctgaacatcgctgttatcctgttcttttttcaaggtgcccagatttcatattgtttaaacaatttgtgcagttaatgcaatcatcacagggtcatgaggcgacatacatcctcagtttatgaagatgacaggattaggagattaaagtaaagacgggcataggaaatcacaagagtattgattggggaagtgataaatgtccatgaaatcacaatttatgttcagagattgcagtaaagacagacataagaaattataaaagtattaatttggggaactaatacatgtccatgaaatcttcacaatttatgttcttctgccatggcttcagccagtccctccattcagggtccctgacttcctgcaacaccccccatcccaggttcaagcaattttcctgcctcaacctcccaagtctttggggttacaggtgcctgccaccatacctagctaatttttgtatttttagtagagatgaggtttcactatgttggccaagctggtctcgaactcctgacctcaggtgatctgtctgcatcaacctcccaaggtgctggtgctgggattaaaggcataagccactgtgcctagcctatagggaggttttaaaacaacacttttcatcatttctaggccttttacctaagatcaagtgtaaaaaatgaatttgagtttctttaatagatacaggggttttcaagttatccatttcttcttgggtgaactttggtaatttgtctttgaactaatttgtcaattttatccatggtgttgaatttaattggcataaaagtattcctagtattattttactatccctttatatctgtagaatctttagtgatgtcacctctctcataccttctactggtaattctctcttttttccctgatcaatctggctgaaaatgtatcaatgtcattgattttcccaaagaacaagacttgggattcattgattttcctctaacctattttctttcactgattcccactttgatctttattattccatttttctgcttactttggatttaatttgcttttttttcccatctttaagtgaaaactgaagtcactgatttgagtcctctcttcttttctaatataatatttaatgacataaattttcctctaggtactgttttagtgacagcccatatattctatgttgttttctattttcattcactttgaattgctttctaatttccctttagatttctcctttgacctatgggttatttagaagtgtattagatgtcagatatttggggattttcaaggatctttctgtcactgatttctaatttaattctaattcgtcatatgcagtatgttccacagagaacacactgtgtatgatgaatgcttttgaatttattgagacttttaaaaatcagccacaatgtggtctagattcataaatgttccatgtgcacttgggaaaaatctgtattctgctattgtagagcgaagtgttctgcaaatatcaatcaagtcaagttagctgatagtgttgttcaaatctactatattcttttttgtttgtttgtttgtttgtttgtttttgagatggagtctcattctgtagcccagtttagagtgcagcagcacaatctcggctcactgcaacctctgcctcctgggttcaagtaattctccctgcctcagcctcccaagtagctgggattacaagcgcttgccacatgtccagctaatttttgtatttttagtagagatggggttttgccatgttggccagactggtctcgaactcctgacctcaggtaatctgcccacttcggcctcccaaagtactgggattacaggcatgagccactgcacccagcaaaatctactgcattcttactgattttctgcccacttgttctattaattattgagagagagctattaaaatatctgatagttatgcatttttctatttctctttgatgttttattagtttttcttttattcattttgaaggcttattaggtacaaaaacatgaaggattgttatatcttcttcgctgaccacatcgtcagtatgaaataacctttaattcctagaaataattctttgctctgaaatctattttgatattaatatagccactctaaatttcttttgactagttttagcatggtatatctttttccatctttatacttttaacctatttgtgtctttatatttatagtgcctttcttataggcagaatatagttgggtctttgtttttcaatgtaatttgacactctctgccttttagttggggtatttagactatttacctttaatatgattactgatatgattaggttgagccactcaccttgcatatgttctctattcatctcatctgttttttatttcctttttccattttcctttgaattaatcaagtatttttatcataccattttatctcattttatctctcttgttaaacagccacatttctttttttttttttgagatggattctcactctgtcacctaggccagagtgcagtggcatgatctcggctcactgcaagctctgcttcctgggttcacaccattctcctgccttagcctcccaagtagctgagactacaggtgcccgccaccacacctggctaattttttgtatttttagtagagacggagtttcaccgtattagccaggatggtctcgatctcctgacctcatgatccatcctcctcggcctcccaaagtgctgggattacaggcgtgagccactgcacccagcctacaattcttttttgttttaattgtaaaccttaagataatacattttatttgaagtaaggtgctgaagaggtgttatttgtgtagggtgttaaaataatggtaagctatgagaaggggaaaagggcactgaggctaaggagttagtttaaaaaaaaacagaccagtacacatgggaatgtttgtgtagttttgtactggggtggttagatttggcagtcgctgaagctatgtatgtaggcaaagactgaatgagagatgaatctggaatggcaatttcaaattagtcactagaagacctcaaaccatcccctctacaaccccagttctgtagatattgaaagaatggtggacccggggcccactctctctgaacttgactcctcacttccctatgaaagctggctttgctatgtgccctgtgatatacatctgtttgtccccactttccaaaagtatgaatcttgtctctggtttacctccaatgcctagaaaaatatgtggcagaacgcatgcttcagtaaataatcttttaatcactgaatatttcaagaattccacataattctataagacattattaactattgtaaatttttaagtggagaaaaagtactatgttgcctttatttcatgaaagcaaccttaagagttggcatgaacacatctatccatctacttgtgtttgtgctcatatactcatatcccacttactatggatgaatggaatgatctatcatctaaagtcaatatttctttttcctaacttccaatccaaggacattattccagaaatacttccttgtatgtcctacattatcaattttgccctctctgtggatgatttccattggcatgcaaacatgctgttattttttctcttcttatagaacattaaacacaacgatcttgactctacttcctctacaattacttgccttttctccattcctttttttgagtgaagcttcttgaaattgttgcctgtgcttactgcattcaacccctctactttgttctctcagaaatcccttttggtcaagctttctccttatcacttcacccaaaggactcttgtgaggtcatcagggctagccactttactaaatccaatggctgtttatcaggtcccattttatgtcaactttcagcagcatttgataaagttggccaccattttcttgaaataatgttttcctttggctttgtgaacatcatactctcctttactggttgcttttcagtttctttttctggttcctctttacccttctttatttttatttcaataggtttttgtggggaacaggcagtgttttgtatataagttttttagtggcaatatctgagatttttatgcatccatcaccagagcagtgtacactgtacccaatgtgtagtcttttatccctcgaccccctcccaccctttcccccaagtccccaaagtccattgtatcattcttatgcctttgcatcctcatagcttagctcccacttacaagtaacaatatacaatgtttggttttccatttccaagttacttcatttggaataatggtctccaattccatccaggttgctgtaaatgccattatttcgttcctttttagggttaagtagtattccatggcatgtatgttgtgtatatatatatacatatatacatgtatatatatatacatgtatatatgtatatatatatacacgcacatatatacacacatacatacatatacacatatatatcacattttctttattcactcgttgatcgatgagcatttgggctggttccttatttttgcaattgtgaatggtgctgctataaacatgcatgtgcaagtatctttttcatgtaatgatttcttttcctctgggtagataaccagaagtgggattgctggatcaagtggtagatctacttttagttctttaaggaaccccccaccctgttttccatagtggttgtatttgtttacattcccaccaacagtgtaaaagtgttcccttttcaccacatccacaccaacatctattttaattttttgatctttttattatggtcattcttgcaagattaaggttgtatcatgttgtggttttgatgtgcatttccctgataattagcgaggttgagtattttttatatgtttgttggccattagtatatcttcttttgagaattgtctattcatgtccttagcccactttttgatgagattgtttgttttttcctgagcagctacaattctttggcttgttattttagtggttgcttatggatttatagtgcatgtcttccactgatcacagtctaccttcaagtgataatatatcactttagtataagaaacctacatcgtatacttcttccctcctagtctttaagctatgactgtcatccattttattttacatgtcataaattccatagtaatttattatttttgtttaaacaataatattttaaagaggtttaagtaataataacaaatcatatatttgtccatgttgttactatttctggtgctcttcattcctttgtgcagatctagatttcaatatggtatccttcttacttttactgcctaaaagacatcctttaatttttcttgtagtgcaggtctccaggtaagaaagtcttaagtctttacaagtctaaaaatgtatttatttcttcatatccgttattctctttttggtagtatctagttggctgtgacactaatccattaaactttccatttcaattatggtatttttcaaatctagatttctatttggtaatttttcccaatctacttgattattttcatactcatgctctttaatccccttgtttctttacgtgtaagacacactttatgtgatgtttggtgactctaatatcttaagtctctgtaggttttttcctctgtacattgttcctgctggctcttgcacattatacatgtttgtaatttttgaataaaaacttacattccatgaagctgtcttccattttgcttttgccaggcacctggaaggcattaaaaacctgatgtcactttaaatttgcagcttgagactttttaggattatacagcttgtgtgtgaagccaccagtgaaagggctgcccatggttatgtattaatgtatcctcactctcgggcgagatgttttccctcaggatggacaattttgtctactgttccaggggctgcaggggatagaggtggcaggagacaggggaggcagacaggttgattcatagttccctcctacactaaacctatctttttggtgtcctttttttttttttttttttttttgagacggagtcttgctctgtcgcccaggctggagtgcagtggtgcgatctcggctcactgcaagctccgcctcccgggttcacacgccattctcctgcctcagcctcctgagtagctgggactacagacgcccactaccacacttggctaattttttgtatttttagtagagacggggtttcactatgttggccaagatagtctcaatctcttgaggtgtcctactttttgatgtcttctcctaatcctcctaccttggacaggatctaaactttgtctgctattctgctgccctatcatcatcccagactatgaaaagcaagtttcagtatgacacttggcaactatcttaagggtgaaaaatggcatctaattacttctttgggtttctactttcactttttaattttaattttttttgcctttgtgaactcttaattattttgcacctcattgatacatttttttaaaatggttcttgatatgtattccagaaatttttgttgttttctggtccttgtcagcccatgttgccggaaataaaattatttcaacttgttctttaacaatttacagtatccatatattccttcctgttccagaggcaatagagtgagaacacacacttaggagccaagctggcctgagattaagatccaccagcaatgtgacctcaatagcctatttacattctgagcctcagtttttcatagggttggtgtgataattatatgaggtaatatatgaatattacttaaaacagagactggtaaggatggactttcttgttattattatctgaaaaatttgaaaaattatgagcctgagtaacagttatacatcttacccattggttcactaacctctggcccctggctaccccagacccctctaccatgcagtcacccacacccatgcttacactgatggagaggagtcatctatgagctattcactggatgacaggcccagctactgtcacagatgcactccaagtccaggacagaatgctagcagatagctgctggtctgagaaatgtcatcatcatataagcctgagtgaaaacacaacccctttactactaagaaatctaaaaacaaacaaacataaaccaacataattttaaattttgtattttttatgatgtcatttgtcccaacagccatctgacatcaatagtcctgattactaaaaatctcaacacattatagaaatgttcttctcctttttgaaaaccatgtttatttttcccccacaatacagtgctatctgcaaagccttgaactgataacatagctcaggggctaactctatcttagcagagtagcagctgaaaaaagaaagcaattcttaacaaacagggagatcaggaatgctcacttcaaaaacattatttattcagggcaagtgggcaagtggtatttctgatgtgcaaatgaagcttaaacttcagctttaatttataagaattaggaaatgcagattaaatctctgatgccacattgtgaattcagtaaaggttaactaatctacgatgcaaagacaaactttagctatcctacacttattattctggaaatttaatgaaaattaaacaagaagactaacagagtataagaattgtccccccgtcttaacactgctgtttccagcctctgttgcctgaaacactgcagaatacttcagatttttttaaccccaactttttattgagtaaaaccaaagtactaaactaataaatgtgaaaaaggatgttgggcttaaaaagaaaaagcctcaagacatcgagcctcttagatattttaaaagtgaagaccgagaaggaatgcactgttgctaaatagaattataggattatggtcaatttataatcttttcaacatgggatttgaatgttctgatattagatacgatgtacgtactttatttatatagtacctcctgagaagaaaaaaaatcaatattggtttatacagtattttgcatgctattcacgtatgcagtgatgtatacgatatcagagctagaaaatggcttagatacgatttgtattcagcgctgggcgggtccggccccgccaagccccgccccgacaccacccccccccctgccccgcctcatcccgccccctccgacccgccccagccgcaccccttccccctccgccccgccccgtcccctccaccccgccccgctcggcttcgtcacctctgccccgcctcgacccctcccctcctccctgcctcgtcccctccgccccgtcccgccccctgaggcatgcgcggtgctcccggcaggcggggctggctgttggaggaatgtgcgaggatctccgtggccggtgtctgaagtcgtcagtttactgcttgtaatgaacatagtgatcactgggaacctggaagtagagactcctttgcgccgtcccgccgtccctctggctgctgcgaatccccccgccagcctccaggaccccgggctggctcaacgcccccaccggccccgccgccccagggcccgctacgcgcccggcataatgggagaaaaatcaggacggaaaggcccagcccctcgccatgcagacgggaagctcggcctgcacatgtgaggacccttacgccccttggggcttcaccccctttgctggctccaatagtctgggtcggggcctccttgtcctgtgggggcctctgggccacaagaacacaggcccgagccccggcgagctcgcgggcctcccaccagccgtgctcaggctgcacttctgcaccccagccctgcacctgcgggaccacctgggtcacttttccattctgataaagtccccgtacttcgtggctgcaggctcctcaagccccaggtctgtgcagggatgagcaaaacagcagaatatccgcgctacatctttctggagcacccattttactaccagatttggaaggaacaaagttaagtaatttccaggataagtaattaaaattttatgatgaaaaggctggaaactcttctcctggtaataactgtcagacatatctgtgcctgaaatgtcagactttctctgagaaaaaaactgagaacctgtttcccattattttaaataggaaacattatagggcacagcaagtcaatagaaaaaaacctaccaatttcctaattcacagtgtggcagtaggtttaagttgcacgtaagttagcaggtaaaatgcttaaatgttaccacgtggtcacccacatttgatatggttgttaacatgcagttgccttggatgcagtagctttggcttgagaccagcaacatcacacgtgaacctctcctttgtcaacacaccaaagctttttgaagtgaccgtcatgatcctgatggtctaccagttgtttctggaagcaacatgtggcttttccagcaaagtatttagtttaaaatgttgtaatttttgaaagctcaaacattatctctacaaccatcagccgaaaaatttgagacaggttcttgctcttttgcctgaactgcaccatgataggggctccagcgatccacctgcttcagcctccccagaagctgagaccacaggtgtgtgccaccatgcctgttaatttctaaattttttgtagaaattacatctccccacattgccgaggctggtcttgaacttctagactcaagcaattttcctgacttggcctcctaaagtgctggaattacagacgtgagtcaccgaccgcacctagcctgaaaaatgttttgtgagataaatagctgctatacagtttagatattaaaaactaagatgtgttctcccaggaaagtaataattttggatatattctgtgtcacatcctgtatgatgaaatagatggcaaaagaatcccatttaatttaaagatggaagctgtaacttcaagtaaatttggagctgaggagtcctttcgggctatgaccccagaattctggggttctctgtactgatattttgctagtgtccacacacaagcattccttaatgctgtgcgttaaacaaatagaccttctttgaccccagatttctctccatttaccattctgtttctctgctccatgcaactacctcacctcatgtcctctcttgaacccactcctttctagcttttctccagggtactttgctgaaacgacttttatctcagtcatttagctgcatttgacacagatgatacaattaaggagttcctccttgaaactctttcttctggattttaaagaccttccgtcctggattccctctcacctttttcttcatcctcctgctcctcctctaccagatctctagtgatcctctcagaatgatcccacatagtctcatagctttaaataccatccatctgttgataaccactaggcttggggcctcttccctgaggggagcaccaagagtcttccctgactcttttcccttcgcccccaacccccatgcaaccatacagcaagtcctgtggctcttgagtgcaaccagcaacctgattcaccatctccatttccacaaccagtttcagtcatcttcctctcctactggtctactgccaaaaatcctcctactgccaaaaatcctccaacctccctgcatcctatcttgccctcctgcagtccagcctccactcaagcatccagagtgatctcttgaaaatgttaaaacatgatataagcatacccccacccctgtgtaaaccctgccactgtctactcattgcagtagaataaaagttcagacaacctggtgcctgcctcttaagcctcatctcctacccttgcttgttcttgctatgtgggtcagattttccggtctccagagctgaaaacaatcttaactgacaggcattagatcatagactctatctacagcataaggcatggaaggaaaagtctgagagaatgaagggccagaaaagttcatttaaaaaaaataaaaagcacaggaaactggaaacataactaacctgtatgtatatactcaaaagaacatggcagcaaaatgaactctttagaaactgagccaacagacttgcaaatgaatagaaatacctttggtcctactctgaaaacaaaaagaatccttagtgaatatacaagaacaaaaattgtacacatttctgggtcataatgcaataaaactagaaataatcgaaagagaatttaaagatgttcagcttcctgaaaatgtcagattatccttttaaacaaattaatgcctatgtcagggtgcaaatccaaaacacaaataccttgcctataaaaatatattttttcaagcaacagtgtatcaggatgtaaggagagagctcactaactcagaagctcccagagtgaccagatgtgttcatgggaaccggagcactgccctggagtcatttgacatcaccttattacaaacaggaacagccatgatggggaatgctcagatgccagtaataagtcagaggattccctcctgaacgggacctcccagtcctttttggcacagggttccaggtgtgaccacaaatccatgggtgagggctttcaagatcaacctgccctcaggcagtggagtggaaactggaactagcagctacagtggaaaaaaggaatgtcctctcagaatatgtcatctgccccatgcaaagactctggatctcagaagtcctcctggtaaggactcggagccagacaacttcatttcctgtcacctgggctgctctccctctgacagctatggaaattggtgaagcacaggaacgtattggaaatggcaatgatgtgcaatgccaatgtgtggaagtgtacaagttaagtaatattttaaaaacagaacacacagcagtttgcacaatctgatcaaagctctgtcatgtatgtttctaaacaagtttggaagagaatttggaaatggctgaatttttttaataaagctcatgtttttagtttgtttaaatgtaaaagcatacacttagaaacaagttagtacataagaatttttaatcttagctatctggaagcttcaaatacctagaatgaggcatttcccaaaggtctctgtaacttgaattttaccgtagtttgaaaactcttgccaggcatactggctcacacaggtaatcccagcactttgggagattgaggtgggcagattgcttgagctaggagttagagaccagcctgggcaacatggtgaaaccccatctctacaaaaaatttaaaaattagctgggagtggtggcactgccgtttgacacagctactcaggaggctggggtgggaggatccttgagcccgggaggtccaggctgcagtgagccatgattgcatccctgtacttcaacctgggcaacagtgccagaccctgccccctcccccaaaagaaaactattagttcatagtgcagttgatgaaataatgtacatccacaaagaaaggagcaaccataatatgtatataattactcagtattaaaatattgtatatagtattacatatataatattgaatacctataatgaatggggcactgctttaagcactgtatactcattatcccacaagaattccttctcgggtaggtcttagtatattcaatttaaaggctaattagtaagcaatacatagaattgaacaagaagctaaaacatagaaggctctcgaaaatacaatgtggaatgagtaatgcaagttacagagatacatagcacatttatagaaagtgtaaaaacttacaaagttaaacactatattatttagataaacaatatattatttagagatgttattatgtaataaaagtataaaagtcagggaaataatatgttttgtaaagcttcagatgaatgattgtcctagatggggaggcaaatggttacatttccaaagggccaaccatgaagacggcttcaaatgtagtggtgtaggtgatggatacaatgtatttattttacttttatgtgagtctgtgtgtatgtatgtgtgtgagtgtgtgtgcaattttgtatgtataaatatgtagtaatttttttttgagtttgggtgtttctctgtctcccaggctgaagtgcagtggcatgatcacggctcactgcagcctccacctctcaggctcaagtgatgcttccacctcagcctcctgagtacctgggactacaactggtaaatattttgctattatagattcggctatcatgttctgttcagtgcctatttcaatagcctctctgccttaattcaccttcatctgcagtgggacacagtacttcttctctaggctacccatggggtaccccaacagcgttgccaccacatacaatcttcatagagctcttaactgcatccagctttctccaggagctcaggatgccccagaccctcatcgcagacagcattgccctggagcttatggctggagatgatatcaccacagacatccccaacccagccctgtcctgggagcaggattctggcctccctattaggcctcagaaactggctgaccacctggcttcacaaacctgtgtgttttcagggaaaattttgatctctacaaaccatgacatgtagagagggacacacatctgattcagcagtccctgatccgctgatccatggacacatttgcccacaaggaataacctagaatttctctctggtggaggtcaggggcattacatgagctgagtagagcttagtttttaatcactagacataggcaaggtgtttaagttattacgcttccaagcagcatggtcctcactcactcaaggtgagataaatattgctgcaaaggaacaacagctgcattgttggagttttgcttttgaggcgtgtgtgtgtgtgtgtgtgtgtgtgtgcatttgtgtgtgtgtgcgtgagttgatttctttcacaaaatacattttcacatacttccttactccaatctacattgccccttccttttaaataaatttttttgaaaactaataagcctattttatttatttacattttttatttacgtttctttacaaactgtttgctattagtctacagtgaaaagtcaacactttataaaataagattagcatttaaaagcttctcaattctaatactttgaaaggctacacccattttcagaaagtctgggctattcaaaatattttacaaaattctgaaacttcgaaaagctgcaagatttggagacagcaagatgaagtgttttttctaacagccagttttgttcactttattattaaatatgcactttttaaattaacagcttgaattctagaatatatttttgaaaatcactaatgatttttgtaaaaatagaaaatctgttgtacctttatcttaaaattcacttcttatctattttctagatttgatgttttgtcattttaaaggatactagacaagaggatctcaatttggatcactatattgggctcctaatatcctaatataattttaaatcatctcaaacaatgcattattaccatatacatcagcatttcccaaactgtgctataagctatgtatacttttgctatttttgagctaaaatatgcttacaaatatataaaaatataaaaatatatttaggtgttgttatgcaataatgcacttttcaaaaagaaacgatataccagtctcaagaatacccggaagctgcatgaaaattcttgattccttttatatatagtgacagaaaaagatgtaaatctaacaattggttatttttattgtttaaagttttttctataagcacatgtgaattaagtattcattattccatattcctcatgtcaccgacgctgggtgcccacagcactgtttttctaacactgcagctgtgggactgagggtggcagaccagacacctgcactgagccacattcgtcacacagttggaccagccctgagccgggggcagaaacatcctgatgtgaaaagctgtttgctaagtacaatgaccacacgtttcgtctattttgaatacaccatcacaacaaactctacactcttgacagatgagacaggcagatatgatctttgaacacaagtgagaaagacgttcacacagactcccatcctccctcacatgactggaggattaaaatggtggtggggggtggatattcagctcaggggcagattagtgacactctcacagctattttaagatacgaaatatttatatgatcctattccaaaccctaatacataaataatgaactcagaactgtacacaaagggaaacaaaaaaccactctgacagtgtccaggtccctcataaacttcccagaagtcaaggaggtcaaggctggtctcaaactcctaggctcaagcgatctgcccacctgggcctcccaaagctctgggattacaggcataagccaccaaacacagcctagtacgttctttcgatatgtttggaatgaatgtgtttccaaggataaaagcttacaatgacatctttcttacctgtaagatacccgaagagcagagagagggtccccaggctggctaagcatccagaacactgggggagctttaaaaacatagatataaattattgtatttcaccccttacttactgaatcacaatcccagggatggaagcacccagagatctgtctttttagaacttctccagctctccaagtggtgctgacaatcaggcagattgagagccagtgcttcaggcagctcatcccagacctcgggagcaggggagtcacccagagctatgtcagactgaaggttctggtgcatcaggggtggggagggtcttgagagttggcctttccaacaagcttcccagaggggctgctttgctgatcctcaccaggctttgagggtgcacagcactcttcctctaggtgtgtgtccacatacctggcacatttgttgttgcattgccccaggtataaagtgcagggtgccccctctacaccttcagccctgctgtctcccctgctgacccccaaatctctggggcttggacttacctttataaagggagctctcagctcaggggtgggccctccccactggccctcttttcccaaggcccggcatcagcaggagctgctcgagcaattcatcccgaggggtctatgtggtgtgaaaggcttagggagactgttctgtttattgttaagagccaggaaacaaagcctggaaacaaagtctggtattgctcaattcagtggtgataagagacaagggtagggcagggtgcagagaagactcccacacatagcaggaccgagtgagtgccaattcttccttctaacactggcaccaaggagagaccgctgtcccttcccataaaggcagtggacaaatggaagcatcgcttggtgtgccagcttctttggggcaggagaacaataggtgacttgaagcagggttgggagccccatcccaagcacagtggatgctgaagggggtcccaggctccccaggtcctgggcttctcttgattctcagttaagcttgttgattgcatatagttgaatatatataggcgaggaaaagacacaagccaagaactgggggcttcagtcagctctgaaaagtcaggaagagcatttcttttttttttttttttttttttttgtgacagagtgtcgctgtgtcacccaggctggagtgcagtggtgcgatctcagctcactgcaagctctgcctcctgggttctcgccattctcctgcctcagcctcccaagtagctgggactacaggtgcccgccaccacacctggctaattttttgtatttttagtagagacgggatttcaacgtgttagccaggatggtctccatctcctgacttcgtgatctgtccacctcggcctcccaaagtgctgggattacaggtgtgagccaccgtgcccagccaggaagagcatttctaacatccaaatgcaaatgtctgccaccccgggctgctttcctctggaaactgcactgcagggcacagcaggtcccaggtttgcctttcctaattccctgcaccacccagctcccgcctccctcactgtgcgggatgagaggtccacacagacagttccttctcacctttgaaatggcagtggtggctgcagcctgggagctgaggccatcccaagcgggtgagacccccaccaggggccctgggtacctgccggccacaggctgtgccatccaggctgtgcacagccacgcctcagctaccaggatttccttcctgtggaactggaccttccatccagagagtcttgcagcagagagcagaaatgggctttctctctgctggtgtaggaaagccatggcaggaaggcggtaccaacaacacacagctgcctgtcccacgtggggtcctgcacctcctgcctcccagctttcctgcccctttactttgtaagtgtgctctttgattaagtgtcctgtttttaattgtgtccaaatgttcacactgtcttaagtgatgctggagccacagcctggggccactgcaggtccttcctctggagcaaagggtctttgtcacagtgtttctctaaaagcatatccatcctgagtgacacttattttagaaacagatagaattggtgaaaaaagggttgagcattataaaatgtctctggatttcaaagaagttggccaccatctatggggaattggggatgagtaacttctctttaagtaaatgaggacaggacaggcatggtggctcacgcctgtaatcccaacacttcgggaggccgaggagggtggatcacttgaggtcaagagtttgagaacagcccggccaacatggcgaaaccccatctctacaaaaaatacaaaaattagctgggcatggtggtgtgcacctgtaatcccagctactcaggaggctgaggcaggagaattgcttgtacccaggagatggaggttgcagtgagccaaggttatgccactgcactccagcctgggtgacagggcaaaattccatctcaaaaaaaaagtaaatgaagacaaaatcccaaaggctagagccaccacccagagcaggttcaggatcgaagtgcccctgtggttcccctcccacctgaatgctctgttttaaaatgaaggtccaggacaaggggagagcatgtcattactaaggttcagtgttaaatagagacattcttccactgatggcagccattatgggccacctgagctttctttggttttccctgccatctgcatggtcctccactgcacttgaatgaggagtcctgagggtctgagtaagttgcagggattgctgtgctgccaggagtgagtgaaagaagaggccagagcagccacctcagctaaaaagaaagccagaggagagggtgggtatttagggagcggggatttttaatttcaagtgaattctgtaattaaggaaatggggtggtggtggtggggctctgggctgggtgctctggcactgtccctaacagcagtcacagtgatggctttgctcctgtgctgctgtccctcctccctctcagcaataggaagaacatgtgtgcttttgatgcacttggtgcagcaggcctgggatgccgcatttcacacaagcttcaggtgaccccagtgctgctggttcatggaccacgctgtgagtagcaaggtcacaaactcccctgagggaggggagtagctggctgcgtttctgagagaccctattacgattgaactactttgggcctcacttcttgagaactcaaaacagctgctgggtgtgctgaagccatattcaccccaccacaaagaggacagtcagcacctttctccacacaatggtaaaaaggttttgttttcatataaaacctcaacagatgaatggggccactatcaatgattttcagaaagaaaggctcaaataccaactattttttttatggagtcttgctctgtcacccaggctggaatgcagtggcatgatctccactcactgcaacttctgactcccaggttcaagcaatccactcgcttcagcctcccgagtagctgggactacaggtgtgcgccatgcctggctaatttttatacttttagtagagatgggtttcaccatgttggccaggctggtctcgaactgctgaaatgaagtgatccacctgcctctgcctcccaaagtgctgggattacaggtgtgagccaccatacccagcccccaaataccaactattctttaaaaaaaattatgattatgttggaggcacagtggctccttctgtaatttcaatactttggaaggccaaggcaggcaaattgcttgagccctggagttggagaccagcctgggcaacatggtaaaaccctgttcctgcaaaaagtttttaaaaaattagccgggcatagtcgcattcatctatagtcccagctactcaggaagctgaggtgggaggattgcttgagctctggaagtttgaggctgcagtgagctgtgatggcaccactgcactccagcctgggtgacagagtgagaccctgtctcaaaaaaagaaaaaaaaattttatatatatatatgtatgtatattatgttgggagagatgtccctcataattaaactaggttaatacagatgattttatttaatagctgaaatggttctgttacctgggagtttgttttatatttagttgatcttggaggatccatcatgaatcccccctagaagtgcccacagtgacatgttccatgagtgcttgatggaaagccatgtatttctaaggctctggtggcaggtagcagttatgcgatggcatgaggaaaatccatttagtagagttgtccaaaagtgcaatggcctggcttggtaagctgtaaattcagtccctgtgaggggtagaaagtgaggatggagaaggaaggaatatgccaaacaggggttgaacaagacgggcttcttccagctgtcagttttgtgactatgggtactgtccatgtctccaggatccacctgggatgcctctgataatgtaaccacgtacccccatttttcttgggcagtttattccaacaagtgagctatagtgcaggcattgggccatgtggtatctgtttgactttcaagggcttaggtcagcttggtggagttctctgggtccctctagggaatcatccaacccagggatggcctgcagggtcccaccccacccctaaagcacttacattcacacaaaatcctagagctgaatgttctcagcaggcttattcctcatagccaaaagccagaaacaaatccagatgttcttcaaggagcgagtggcaaaacagttggggtcattgtggaaatgaagggaagcctttggagagatgtattggaagaatgaacaggactcagtaatggattgtttatgacgtgggggggttacaggctgaagaaactctttctagagtctggaatggagtccctaggtgagctgtcacaccatttatttagacagtaagtctgggtcacagccaagtccaggaagatgacctagactatagagtgggatcagttctaatctgtaatgtctaagaggtatttcagtctggaaatcagctaggcagctgtacatataattctgagtggagataaaatctggaggttgtaagaatagagttaataattagtgccttaaaaatcaatttggtcacccagagggcttggggttctttttttctggcataccaataaaagaatagcagagttcaggggtgagttatgatgcacttcagattttaaatcccaagcaggggttgtaagcatgctggcaaaccttggggaggagcatccagaaaggcaggatgagaaggagaagcattggcttcaggagccaggagcaagatggaccccagaaacaaaaaggagccacttacctggactgttcctttgacgtggtaaatggaaagtggccattagattttccatcatggaactgtcaaaggacaaaagtacaacagatttagtttaaagatcctaattggctttatttgctattctagaatcaggcaacagttcattccataaaacagactgagcgttcctccgatcagagatggggagatgggctttatggatagaaaaggctgaagcagaaacagagaacaaaacacagattggttgcaaagttactttccttgtaaacattaaagcagaggggagggactgcctatcatgctggctaaacctggcctgttggggatttgcctgttatctctctgtgtcctgacttctcagaaagtcagatcaacaacttcgttttggtttggaaaagtggaactttagcgcaaggaactccaatccagtctggtcttgttactgaaatgaacctgggtctgcttgccccgtgtggtaaaaccaaacacccacactgaggtttgcagcaggagaaaggagggtgttaacttgcaggacaccaagcaaggagaatggggcagcttacacttcagacccaatctcctggatggcttacaagcaagggattttaaaggcaggggaacaattcaggaaagcagaagttacagggaaaccataaatcaatacagagggtatacattgttttggcccaaaaaggtggaagctcttgaagcaaggggcttacaggtcataggcggcttcaggattctttgattgcaattggttaaggaagccaggctttgttgaaaacttggggtcagcagaaaggaatgttaagatgtggcctgtgggcatgactccctccaggcccctgagaaagaaatttacaacaaagagcagccatcagagtgcagccctcagctccccgacatctgaggtctctgtgatgatggtcagtattttccatctgacgtgggtccgggtttctgaaaaaccattcatggacatatgctaagatgtaatctttagtttcaataggggaccaaacaccttgtggctctgacttacttgagtggctgttacttgaagctattattcccttcttgcttatcaggtggctcatttacttctcaaggccagctaggtacctggaatttcccttgaaggaaatcaagattttcctttgtttccatgctggaggaggcccagcaggcctctaataggggtccatgctccgtctcagtctgttgggcctagtgcagaagctcagtccaaactaatggcctcctgtaaatgtattttacagaagtcagcagtgtccacagcaagggagagtttcttgagcaacctgctgggagacctaagagtgaaataaagagtgaatgtcaggtgaaaacattgaaaagatgaggactgacaagtatttacagggggttaactctgaagtggttccaataaactgtgatcttgaaaagcaggtagtggagggaaaaatggcttccccttctaggttctttggctgggctaggaattaaattgacataagacgggctaataggagaataaaaaactttaattacgtctatatgcacaggagtcccacaaaatatggatgaggagaagggccagatgaatgaagcttagatagtgtcctgagttacagaaaggaacaggggcttggggcttgctgaggatgggcacaagttctgggagggtgaggggaggcaatgtctggtgaataaaaggtgtcttgttctgcagagaaaagtctctggggttatagaagttgtctggaaccagccctcttcctgatacagataattcactaatgtagattttttttatagttataaatttcttttacaaaagggcagcttttcagagctactcctgtgtctgcaatttcttagaataacaagatcaaaatttgcctaagaagtatattttgtgttcacatatctggttttgtattgtcatattttggggtggtgtgtcctgagccccaccagcaagggccatgttataggaatataatttttaattgactttttagagttgttttgaattcacagctgaaggggcttagagtataccatcccaaaatatgccactctgacataaagattattttgagctgaagacaactgagaccaagtagacacaggacaaactctctgccctgtccccatctaccagaagggcaggatggctcttaccagcccagaggtggcaccagaaaaatcaacatcacaagcacgccaaatcaaccttatctgtcagcttctgccatatatctaccttcccacaacttgttatccacagaagctcaaggtccccttcctttgtctttccacttctctacaaatacattgctctctcattagggtgctaataagcccaagttctaaccgcctttttgagttattatcactgagctctcccatgtgtatttgcgatgcatgaattaataaatgtgttgttttctcttgttaacctggctttcattggtctaaatttgtggggccaaggcactaaacctaagatgggtggaggaaagattttttctaaacctatacagcaaaattgagctgagcgtgcagagaactctcatatgaacccctcaccggcccacacatgtgcacacacacacacccacacacgcacagcctgccctactgtccatgtcccacatcagtggggcacatttgttactacagctaaacccacaccaacacatcattttcacccaaagtctgtggttcacattagggtcactcttggtgttgtattgtcagtgaaaagagccaaactctgtaaaatatttgaagagatttattctgagccaaatatgagtgacccaaggtatagtctcaagaggccctgagaacatgtgaccaaagcggttgttttacagtttggttttataccttttaaggagacatgagacattaatcagtacatgtgagatgtacattgattcagtccagaaaggtgggacagctcgaagggggtcaatgggaggaaggcttccaggtcataggtggattcaaagattttctgattggcaattgattgaaagagttattatctaaaaacctgcaatcaatagaaaggaatatctgggtcaagataaggggttgtggagaccaaggttcttaccatgtagatgaagtctcatgggggtcacccttagagacaatagatggccaatgtttcctattcagacttttaaaaggtgctagactttcagctaatctctagaggattgggacagcctggaagggaaaagagctagttatggtaatagagattctttacaggtgcaaattttccccacaagagacagctttgcagggccatttcaaaatatgcaaaaaaaaatcctattttggggtaaaatatttttatttccttctttatctgtcatatgatgttatacgagagtcaggtgggaaagtaagctgtgttatatataaggttaaataaagcccatctgttgagatgtcagtttctagggtatgactccccaggccccttagataggaatttgggcaagagagaaaaaatgtcagtttagtcctcagtacattctttgggtttgaacagatgtctaatgccatatccaccactgtcatatcatacagagtagtttcacagtctggcaaatcccctgtgctctgcctgttcatccctctctcccccaacccctgccaaccactgctctttttactgtctccatggttttgccttttccagaatgtgacagagttggaatcttacagtatgcagccttttcagatcagtttctttcagttagtaatatgcatttaaggttctttcatgcagctcaataatgtttggcagagactcaaaggcagggagaggaatgggaaatctgcggtggaaaaggggaagaggagtcctgatggggttgccagccaccagaggcggctgctagtgaagtggcctcattgtctggggtgacacccaatgttcattgtctcacagccacagagatcaagggcatggacacacaaagggtgaggttaagagtggaaatttaatacgtgaaagaaagagaatagctctctgctacagagaggggtcccggaaaaataggtcgctgatgcacagtgcaatgcaaagatttttatagatgagctagtggggagcagtgtctgatctacatcgggtgtgaaaaaacaggaccaggtgtgccatctgcatagggcacgaatctctggacgcccccacaccaatcttctatttattacgcaggtgagtagctactccatgttgcttatttctttcttactgtgcatgtgttaacaacaacaaaaaaaaaaaaaattagggaaggtgaaccccccatggtggacatgcctggccccaggtagtcctttttatcagtgtggctgcaggcctccccccaggcaagcttccagcttccttaactatgtttgcagctccatctttcaggctgctctttgttagaaagaaatgatttcttgggctgttttttgtcagaagttctgccaaggacttttttgccctatctgcctaaataatttatttccatctcctgtatccagtcaggggatcctacctgactggtaagagggtgcctatttggttctccctgttggtcctaggttcgaagcaagggcaaaaaggagggaagccgtcagtgcagtcctgaccattagggttgctgtatgcagtttccagctggttacttcacagactgtgggtcagagtgtcaccaggctctcgggtggattttttaaatcccacggactgaaacccttctttattatctccagtcacttgaacatctttctttgattgacagtttattcagtgttattaaaaaaaaaagctgctactattactactactactactacaattactatttataataatggtaataattatagtaatgatgaatcccagcaaggaccaaataattataattactgatttaatatttatacataaatatttattaaaatatataatctatatattacatatatttataccatgacatttatagtatctacataattacatattatttgtgtatttatgactatttatatttataaattacataataataagaagaatattattactatgactactataagcctcaggactccccccgccccccaccataacagaatatacccctttaaccatccagccacctaatcccacgttgcccccgctggtcgagcttgctatatataaaggcggctgccaactgttgcaagacaactagctaaaaagcctgccgaacagatcgggatcgcgggtgggcaggtaggacgccaggcctcgtccgggtccacctcaggtcacattcccacctcggggcaccctggcaggcatgagtggaaccgtgagatccctggtagccaaaagaagccttggaaaattttggggggagcgccctgggccagggacagctgccgggcaggggacagactccccagcgcctcccgggccagctgcccacccagagtggacttcaaaattcaccggggtcagcctgcctcagcctccccaggggcatgtagaaatttctgcggaccgaaagcccctcctgcgtcctcttcggaactataactgtttatatctaattgctatttatgtagattgattatttataaagtataatttatacttctacaaatttatattatttatattcatatagtttgtaaatgtaaataaattatttgtttataatacttgcttataagaattaccattgctgtataaacctcaggttccaccatccccctgcccctaccctccccttcgcaccttgccacgtccttctcccctcgccttggccccttctcctctcccaaattctagttgcccatctgcttggttgggctgctgatcgatctgatcaactttctgaggccacatcaaaactgcagaaatgaggctgatcgacccagcagctctaacaaagatcatccatcggacatctggtcgcctctctattttggagccagaggctgtacgctcttccccggtggggagggtggggccccaaagtccaaccacaagatcccattttgcaggccgcggctaaatccactgcgccttccccgttttttctcgaactgcccaagccagactccacctccaagacaagactcggaaaaaggtgtgaagctcaagtcggatgaccacgacccacgcgtggccacggacgggcccatgttattcttcgcagtcctcctgtaatggccgggcgggtcctcgcctccagggcggggcttggagataatgggtgtaatggaaggcctgaggacccggccccacgccagtcggagtccgggcggagtaacccatcccccgttcacactctcggaaggcccgtcgattcctgcgtgtactagtcgacccgctcaggccacagcactccgagctcaatagtgcgcctccaacgctgacccgcaggtttaatctccgacgaaaggacgaagagtacacccggcaaagccgggctcatcctgccagtgctgccagtccccttgaactctgcacggcgccctgtggccaaatcccctttcttgccggcttcgccagagcgccggagagaaaaccttaacagtgcagccaggtggcgcccaacagccggcgcaagcagccgcggatcggatcggcatagccagcgggcgaggcctctcctagtccctgaccacctgggatcgcgtttcttggcctgggccgggtggaggagctcccagttggcacggcctggaatgacgcgaccccgcagccgaaggggacttgaaaatttttcctaaccaccgttccgctccgagttactgctacctgctaggacagacctcccacgcggctccgggcctggcgatcttccgcgggaaccgggaacgtttccggagatccccgcaggccggcgccctgcctcggcttcccagtgcagcggggtcgcgggctccccgaggattccaaagttttgcggggcgcctgcggcgggagggaccctgaagttgaaactgtgaaaggcagaacgtgggtgaatcgcttttattctgtcttttcggagtgggaaagcctttctaaagcataaaataaacccagaagccatcaaggaaatgattgatcagcttgacaacataaagtttcacaagcaacgtcaaaagataacaaatgagtgtggggatcgcttatgcataagataagaatattgatttcattcacaatagccaagatacggaagcaagctaagcatctaccagtgggtgaacggaaaaagaaaatgtgatgtatgtacatcagggggtactatcccgcctttgaataaaaggaaatcctgctattggcgacaacgtggatgaacgtggaggccattgtactaagcaaagtaagccaggcacagaaacaaataccacttggtctctcctgtatgtggaatctgaaaatagttgaactcatagaaacggagagtagaactgtggctacctgaggccgggggaagggcaggagggaggagatgttgttcaaagggtacaaggattcagttagacaagaggaatatgttttagggatccacatgacacggtgactgtagttaatgcattttatatgtcaaaatccccaaaatagtaaattttaaatattctcaccacaaaaaataaatgtgttggtgatggatgtcttaattagcttaaagtaattattccaccaatgtatacatatatcaaaacatcacattgtatcccataaatgtatacaattatgatttgtcaattaaaaataaactttaaaaaatctttttaaaaagatttcagcattatttactataataacaaaaaaactggggtgggggtaatagccattgattaagaggggtcaggttaaataaactccagtacatccacaccatacactgtgtgaatttgttttgtttgttttagatgagataaatgttgatgatgaaatgttaaatgaataatttaaaacaagtattaagttacctctatttcaacacattaaatagctagtaaagactgtgtggtgtggacagagggatatgatctacagaaccgaaaagagaccaaaacaaatgcacccagctggtttttgacaagcatgcaaaagcaccttgtggcaggaaaggtagcctttccatcaaatgggagtagggcaattgcacatcacaggcagcaaacaagcaggcaaaccaaaacccttgacctagacactgtcaactttagaatcccaggcccccaccaaatgaatggaccccctcttggccaaggggacctcaggaaaatcttaaaagtttagttctagtctgcctggggtgggaggtcaaacatgcctcattataccccctgccttttggggtttagaccagcattaatgttaacatagagatcagaagactgacagaacagactctgtggcaataaaataccaagttataaacaggacctaaggccatgccaggcaagggttaagtcactaacactacgcctaaagaataaactgtgttccaaggaccacaaggcttttgtttttctctggcagctaaacaaccactggcctcaagatagacaagattaaaacaatttccagctccaccacccactgacttactaaacccctgctctaccagccataacttcctgataagaccaccaactatggattgtctttggctggtttacagaggctgcacacttgtgtgacttcatgccctgaaaagacctgttgacatataggacctaactgtaatacatttaaatgttaagtctccaccccaaagtgaacatggatcatatgctacatgcatgtctgttcaatatgcatgtgctaggaccaccttcatgaatattcatagctcctcctataacctgttgaatatgtatgtttagccaacctgcccagcataaagctcctaccctaacccctcctccttcaaagtgccgtttctggtcccttggctgagatggccaccttaaaggctgtaatccttatgagaaataaagtctcctcatgtttctaaatggataaattgtgggggttttaccctcacacctcatgcaaacattgactccaaatggatcacatatttcaatgtaaaatgtaaaactataaaattttaggaaaaaaaatcttagagaaaattgggatttaggctaaaaaatgagattttatacttgacatcaaaagcatgattcataaatagagatgggtaaattggaagtcatcaaaattaaaaccccaggctctgtgaaaggtccctttttttttttttttttgagaaggagtctggctccatagcccaagctggagtgcagtggtgcagtctcagctcagtgcaacctcctcctcttgggttcaagcaattctcctgcctcagcctcccaagtagctgggactacaggcgtgcgtcaccactcccagctaatttttgtatttttgatatagatggggtttcaccatattggtcaggctggtcttgaactccagaccttgtgttctgcctgccttggcctcctaaagtgctgggattacaggcgtgagccaccacacccagctgaaatgtccttttaagaggaggaaaacaaagtatagatcagaagaatatatttacaaaccatatattctacaggaatgtgtaaaaaaaaaaactcaaaacgcaacggtatttttcttcaaaatccaattacaaaattgatgaaagacatgttaaagtatgccccctgcagaaagacaaaatgactcccaggagactaactgagttgctcaaagttaaaatggaaccaggcggctgtagctgggtgacagagacttcatgtactctgtgttcttagaaagatgttataaaagtatcacaagacctcccttccacaaccaaaccaaaccagttcctgttgtcagtgtcaagataactgtatccggagcaccacttccctggacccctgacagccatttataagaaatttctgacagtcttctgcttaaggcttaaagaacaacaagtcagaactcccctgccctgactaatcaggactcaactgcatcaatcagggttcacctggatcgactaatcaggattcagctacatccaccgatcaggacagcatgagtttcagtccttcatttacataaatgaaagtagttggaaacctggacagaaacttttaccatagagcccaaaccctttcttagttttctagaacttactttccttttacactgaaggctgcaacttccccatttacaaactgttcactgaaataaagtcactttccacattccttttcagaaaacttagctcacagacacgaactagcatttcactgagcaggacgtacagatggcaggtcggcacatgagaagacgttagccttttgtgggagtgtaaattaaaatgacagtgagacgtcatgacacatccatcaaatgccttcaacaagatacaggaacagcatcaaatgcaggtgaggctgtggaggaacgggctttctcacacattgctggtggtaaggtaatattgtactgccactctggaaaacagtgtggcagtttcaaaaaagaaaacagcaacaacaaaaacatgcaagtgaagcgtggcagaatatgccaccccaaaatatgccactttagcataagggttattttgagctaaaggcacttgaaaaacagcagacacaaggaagatgccctgacctcccctttttcttcctgaaagtaggaggtgaatctcccatgggaaaggtgccctccctgtaccaggaggaaggaagcaattcttaccaccagaggcagggagttggggccgaggggaatctgtacaaacaaatctcgttaaactaaccctcatctgcctcattacttctccacgatgaactgccctatcccagactccattgtcttcaggttttcacaacttactctttgtccaacctagtatataagtgttcaggcctaactgcttcttcggatctctttttcctacagggttccattcacatgtgcaaatctgtgtgcttttctcctgttaatgtgttttatgtccacttacctcttaggcccagccagaaacactaacagtagaggtaaagttttgcttcccctgcataaggaccatgtaacccagcaaccaaacccctgggcattcaccccagagacaggggaacttgctgtgcttgaagggttgattcagtgcctctggggccgaggactccccctgacctctgaccctgggctacagcaggaattagaatatttcccagcctgaaactcctctttcctcaacttcagtcaaccagacaccctttgtggatggaaaaatctcattcagtgtttttataacaataacaaataataatggtaatcattacaataatgatgaacaacagcaacaataactattattattattaaccttgggggatgaaagggtagggtacagacctccacaatgctcctggagaatgaccacctactcctgctgggtcccagggtgggctggggtcagagtcccaggtttgcacgtgcaacatgctctgtgaaggcaaggggtgagcagcaggaggaaagggaaattaccctaacagggtgtggcagaccagtgaggaccctgggaggagaaacaggggagggatgtgcagggagagggacccaggtcgggcacccgctgcctggtcagtgagctgccaaagcttcctccacaagtgctggactccttgtccatgcctgcctacccggcccccggccagcaaaccgcgggcaccagctcatggtgcacagaaatatgcactccagatgaatcgcacacctcgatgttaaacgtaaaagagaaaacctcagtagagaatgctaagcgtttgtgtcccctggagaaatgttcttcagtgtggcacagcagaaacccaggtggtcagcagccccatctggtgtggtgccagggaagagcgctgacttgttagagcagcctggagttctgcctgctgcgatccatcacggcggcctctgcatctgcagggtaaggccttcaggtttagcactgcaaacccaggcatttggagtctgttgggccagtatcgctgctcaggtgcagatgggccagctgacttcacctgaattgtagctgccagccttcgtgagaagtgggggcgcttctgggaccggccggctggggcatcgggtgcaccatttctacttgaacacacgtcccccaggcacttggggcccccaacacggaaagcggccatgaggtgctgggcctccctctggctagggggagcaaggagacagcgagtgtggcagccaggactgggcctcagtgctcccagcgggtgggggtgtgacgggtgtagtcaggccaggtctgtggggaaggtttgtaggactggggctgggggctagccttgagtcctgagccacccaccagtggcaaactgcagttttgcagaggttaagcctccggcacctctctaaggcagctaggctgggacaggactggcaacagcagcaccaacacctgtgtgtcctgagcagggggtactgcactcaccggctccaaccagcaacgtcattaacgtttttctccactgtgaggatcatgcaaaccctaccagtttgattccaatgttttttgaaaaacatacttgaacacagagctgggagttttgacaggtaggctttaggagctttgtcaccaccaccaggacacagggatctcccggcaaggtgctcagggacctgtggggcccagaggccagggggctgggagggcctggagtggccagcagggaggctgcagagccatgcctcctcctcccctaatcaccccagcagaccttcctctgagaagcagcagaccagggagggggcatgtgtcattctctgccagtcactttcttctccactccaccacctatgcatttaacacagaaagtgcatgaggccacgctgtctgcagtcagccaccgccactgctccatccaaggactctgcactggaggccagcaggatgccctgggcttcctgcaggggctaagccatgcatgggtcccagtgcagtcaaggccccaaggcagtgagaaaggttcagcctggaggtgggtggttaggcataggtcctcgagagtccctttaaggtctcaatcctagtatcgcgtggggtcccattgctgtggttcaaatttctcagtctttcccttgattttgctggttttgcctctttacagattatttccttttgggttttctctacttctaaagaattttttgttgtaattatttcagacactgcctgagaattgagattttatggttttcaagagttacggttttcaatacatcttcatgttccctcatcctattctcctagaagttggctctgtgctgttagctgcctccacacatgtgcccttcatttgttaggactcaagtgtcacatctgaaatgggggctagcaaggtagatctgcaagacctatcccttggttgaagtagcaagccctggagtggcccagcaggtgctgataagctgacctgtgagagactgaatatacaatgacagtggctagactacataaaaaatcaaactctgagccataatctgcagcaaccagccccaaagccagcccgagatctgcagccacagcccaggaagccagcccgttagaagtcagatgtgcaggaagccagccctctagaagtcagacgtgcaggaagccagcccgctatctccagtcaatccagggagcttaacaccgccctgtaacaatcagcccaagacagtcagaacttgactaataacagcttccctaatttttgtcccggcttccaacttagaaccaaccagaaaaagtgaaatctactgccctaaccgaccacacaggaggccccatttctggtcggccaccccagtttccccaagccaacagcctccactcggagtgcacctggagcctcccctttttccactgtgaacctttcccatcctctgcctgcctggaaatttctaccaaaatgcaactggcgatggctgactcccttgctggggcctttgtgtctctcatttgagtggtctttgcttatctccatgctgcttgctatgctactacggatgggcatttcctgcccatccacgaagatttcacgtgcgtgcctggggtggcagcatacccaggtgcatttctcctgcctcctccttctctctttatcccgcagtcttcctcctcacccagctagccacaggtgtccacatggagcacagtctgaggagagagcagggtcaaacacagccaggttctaggtggagctgaatggggtttgacaggtgccaggtgctcccccagatggatctttacatcataaaaacgattttgtgcttgaagatgtggcttcagatccaccaagcataaagtcaccacctgaaattagaaagaaaacatccaataaataggccttcttcactccagcaaccctctccccatgtgccttctgaagctcctgcagcaagcctgcagatgggttcagaaagtgtttccaagaggagcaccacacagctctaacagacagacagacagacacacacacacacacacacacacacacacaccgagtcaacatgagggtaagaatgaggagagtgatggctgcagtgtctgagagaatttagtctcaaggattaagggaaggctccccaggcgagtgggaaaggtgagcagtgttcggtctctcagaggcgtggatggaagtgtcgtccaggcagaagacaaatgcacaaggcttgaagccggagcaaacagcttccatatgcaggagtgaaaatggcaggcacttctatggcaaatccaagagtgaggcaggagggttcagggcctagcatgccaggccagtgactttgtggaaccagcaaaccaagctaggcaaagtgtggcatgttacttccttataatatttttaattagaatcataatattttctctttaatgcaaagaataaataaattcttaaataatacctagcccaagggccactatccagagacactcaagctgccagaatttttaatgtatctttcaagaaatattttctatataaacagaagcctgagatgtatatgccattttttgtggtctcttccaccaaaacttcctcaaatgtattaagagcacaactcttgaaaacatgttcccactgaaacgtgcacacaaacgttcttagcagcatcattcattatagccaagaagaggaaacaacccaaatgttcactgactgatgaataaacaaaacctgctccatccacacaatgcgacattcacacgtgaggaatgccgcaccgtggtgaacaccagaaacagcaagttcagtgaaagaagcccgtcataaataactccattcatggaagtgtccagaataggcaaattcgtagaaatagaaagtagatgagcggttgcttaggtctggaagggatggggagcatcctgtcaggatgccgaaaatgttctgcaattgactggataatggcttcacggctctgtgaatatgctaccaaccgctgaattgtacacttcagtggtgaattgtttgaaatgcaaatgacgtctcactaaagctcttattaagaaatacatgagttgatggcagatggctatcaggattatgagggtgacatctcaggggaggagctgtgtgtgtggaggtgctagaactgcacaggacatcagccattaaagggtcctctgatctaaaaataggaattgtgatctgagtaattaatgagacactggctgtcctgaatttgcagctagtaaaaaagttgtgagtcaggaacaagcttggtttttccataacaggattttggctgctgtataagagaattggctggaagaagcaccattcacaagcacttactgtcaagaagcaagaagcacaaagcacttatcatcaagtaagaaggacaggactcccagtaagggggtagcagagagatgttggcaactggacagatgcacaatacacttgggaggcgacactgacagaacatgtctctggggacatgcaagaagaattaggtaaaagcataggttatatcagggtatgtcaaaaacagtgacaggagcaaataaataatctaaattgaggaatgctgatttgagaattctcagacatggattactgatggaaaagccaaactctgtaaaatatttgaaagaggtttactgtgagtgaatgagtgaccgtggcctagggaaacagtctcagagggcctgaggaagcgttcccgaagcggtcaggttacagtttggttgtatacattttaaggaggaaagagttctaggcaaagacataagtcaacccacgcatggacggtatacattggtgtgacctgaataggtgggacatcttgaagcaggggtttaaaggtcatagatggattcagagattctctgatttgcagttggttaaaggagtgagctctgtctaaaatttgatgtcaggagaaaggcatgttttaagttaaggatgctatgtagcaaggttgatggcctgcaggcctgaataaacccttgcctggcatggccttaggtcttgtttataatttggtcttttattgacacagaatctgccttgtcagtcttaagatctctaatgttaatgttggagagttgcacctaaactccaaaagggaaggagtgtaacaaggcttgggatccccttggtcaagagggggtctgttcagtcaatgggtgcggcttaggattttatttttagttcataggatggatcagattgtttttcttttgtgattacaaataaggctgaggccaagcatagtggctcatgcctgtaatctcaacactttgagggttgaggtgggaggatcgtgtgagcccaggaattcaagaccagcctgggcaatatagggggacctcgtcgctacaaaaaataaaaaaaataaaaattagctgggcataggagcccactcacgtggtcccagctgctcagaaggctgaagcaggagaatcactggagcccaggatttcaaggctgcagtgagccatcgttgtgccactgcactccagcctaggcaacagagtgagactgtctcaaaaaataataaataaataagcaaataaataaggctgaaatgaacagcctcatccatatcttttcatgaacacccaccaacttttccctccgaatagctttctaaagctttcgaatagcttatttttaagtcatgcaatgacttgacaaattgcgtgttaggaagcctgttacgaatttagactcctgtgctattttgaaatagatatttggtcttcatccccatccccacttcctggcaaaaagctcctaaaacccttggaatctgcagagtactaagagtgtcatttgtgtgctaatgaaatgactggtggctggggaccctagacagcttcaggatgggggctggccaccagaaagacagaggtgggattagggggttgggactttcacctcacttgccaacatctggggagaggagagggactgaaggttgagctgatcaccaattgccaatgatatggtcgatcgatcatgcctctgtaatgccgcctcagtgaaaacccgcaaggacagggtttgaagagctcccagatacctgaatacatggagcctggagggcggtgtgtctggagcaggtgtgggagctctaagccccttcccagatgcctcaccctgtgcacctcttccatctgcctcttcattttcatcctttgaaatatcccttgtaataaatgaataagtgtaagtaaagtgtttccctgagctctgtgagccactgtagcaaattaatcaaacctgaggaggggatactgggaatcctgatttgcagccagttgggcagaagagcaggtcacaacctactacttgtgactgacatctgaagcggggacagtctggtgggactgagcccttaacctgtgaggtctgacactgtccaggtagagagtttcagaatggaattgaattaggagacactcagctgttatctgctgaaggagtggttgatgtggagaagtctctacacattttagtgaccggtgatcagagaaacacaattatcctttggtatcttcaaatggattggtcccaaaactcctcccctggaagggttttggtgatttggacaccaaaattactggctgctcaagtcccttatataggaaagtatagtatttgcatataacctacacacatcctccacatgctttaaatcagatgtgtccaatcttttggttttcctgggccacattggaaggagaattgtcttgggccatacataaaatatactaacactaacaatagctgatgagctttaaaaaatcacacacacaaaaaaatcatatgttttaagaaagtttacgaatttgtgttggagggtaggccacagattggacaagttgctttaaatcacctctagattacttatatctaatacaatgtaaatactatgtaaatagttgttatattgtattgttcagagaataatggcaagaaaaaagtctgtatgtttagtacagacacaatcattctttttttcaaatgtttttgaatcgaggttggctgaatccatggatgcagaacccatggatatgaaggagtgactgtattctgtgtggaatttatgctgaatgggttggcagaacatacatattcaataagctataggaggagcaatgaatatttatgaaaggagaaacgtgaatgtgtcattgagtttcatgactcttcatgggtcatgtgttcatgggagggtgtagtttttagcctctgacatcaaaaggcgaaggaggggccaaaaaccactcactgtgcatcctctgtgagccagccaaaactggtccagaggcagtggtccattttaggaaggatgcactgtgaagctggtgactgtcactccaaaactacaaagaggtagggcgagtccagccacggcctcagatgattggctaaagatgataaaggaaggagtcctgtgtttcttgtttaccagagctggtttctgcttactccttaggaaagagttctggctaaaggttaatatggaagggacatgctgaagtctgtctgaccttgcatcccgtcctggccaggagctcagtttttaagatttctctggggtccctttggccaagagagtgttctatcagtcagttggggaaacttatgatttaaactttattccttgggtcagtttaatagaccttgcaactttaaaataagcattatcaggtctaagaactcagtgtgtgagcaccactcaagcatcacaacctgctgccaagatgctaaatgttgtaagaaaattaataacttaaaggcaaaaactgacctccatgaagatgaaaagtctgatggcactgtaactctagagaaaggagcatgtgtccccattgaggggaaggcagcgtccatttcagggcacactgcaggcatgtcagggtgtttcaggagtctgccaggtgtcctgtcttgtcactcgagactccagcccagggacagacagaaaaccagaagacagcacctcctggccaggatcccagcatccatttgagggagacaagatgagaagggacaatattgttgtagcaaaaataataggttctccacttccttacataggaggaaattcccacaccttgataggaggcagttccccttcctgcccaccttggcacaggcggtcacactccccacctgtatgttgagggactgtgcaagagggcagcactgtctgagttgggacatccacaaccccctgctcctgcccacccttggcttgagtgctggcgacggcaacgtcccctctcagccctggcctgaggtcctccacccttcttcagttctctctctcaggcctccatcatcccacagcttttcttccaatctctcctcttttttctttttgatgacgtttcaaaagagtcagcattttggaagacaactgtagacttgctttcaaatgcagagcatcagagagccatggtctgcccacaggtggcctgcagcagggcagagctgtgcctctgatggccaagggggaggtcacacttgctgcctctgtcctccttaatgctcctgtgacacaattagaacaaagcctgactgccgtgatgaagaagaggtgaactcatgctggtgggtgtcttgtccagagcacgtcagccaccccgtgagttggcagagccaatgggcagacacacaggatgaggttacaggaagatgctctcctgcagcagatccaaggagacagagaccccagcagatggcccgagaagctcccacctgcacctccagcatcaacaggcagacagagaactcctgttagaggggatgaggcaagtctgggacccttagaagactgcaggaagagctgcagatggtgcgaagcaggttcactaatgaccagtccaagggaggcctcccattgcatggagagcagcagagaccatcgctgcccctcccacaaggagtagttggtctggaatatttgctacttacaccttatgaatctcccagttactcgttggtgtgcttttaactaacatgagaagcagggactgggctgtttgttgagtattatgtcttgatattttttagttcagttgtacatgttagtaacaagggtaggggtgcagggtgtcctcatgcatggctgctataaaggtcatgagcaatcaaaaatagaaataactatttccattaattaggatattattgtaggatgaaggtggagaatgtatgctctgaacatgaaaaagagggcttggatcacagctctgccttctgatattttgtttgtttgtttggagcaggtgcttgatcctttaggtagaaagcaagcttagtgaagttaagtgattgtccaaaatcatgctgcttcttaccagttggctagaattcaaacccgagctgacttaaataagagcccaaatttacactggttatgtgggagaggggttgcttttgtttatttctcattactgtgaaaagacatcttatactcagtagaggatatagagtctatttttatactctaaaaattataatgacatgcacatgcatgtaccatcacccactggagacatgcaccggtccacctgcctttgcagctctcatttcacattccagccgcctgctacactcacgtcagcggtgcatagaagaacttcggttatttctcgtgtgagagttcaccttttgcaaaggctgacaggaagtggatgatgaagaactgagttttatgtaaaggagagggagaggtaattgatggatcatggctgagtgcaccgcagggaggaaggatggagggcacgggtggaggggaaggtcatcatggcagagacggggacatctcagatgagatgcccagaggtgtaacaactctgataggaagctgtgctgtgtgccacatgcctctgcaggctgcagaccagtttggatcttactggtctatgtatcaagatatggagtgagcttaccctctccagactgcaattcctgtgagtttctctcttctccttggaatctgagtttgttggttccagagtagctttccagctggggatctggggtgagatttcaccagccaaaggctgttggaaggcaaatcaggatgttgggtatgggctgggctaactgcagggctggactgagcactggaccctcagggtgtcacccctggggcagggtgggctttgggaagaacacagccctggcaggtgcccacctctgcctagtttgtgctggttgctatgggagtgaaggggccgccaagtggtagctccaggtggggctggccctccaaattccaggcctataatttatctggcacatataacccctcatttgaggcttaatttgtttccaaagccttgagtttgagagatcttacaaaacttttattttattgtcatcatattgtgacaagtgaagacatactccaacaaaaaattgaggataaactccagtttgatgagtttttcctccttttggtgtgttgatatcaaggacgctgttagacataaggattaatatcaggtctgcttttcagacactgacgcagccaggagaagggggacatggcctccacagagttgcaggtggagcttgccttgcagcaaggaatcccaggccaaactaagcagggcaagcagcaccattgagtgtcccactgcgtgattggtttcatgtgttgaagaatctacagcctggaaaacaagtggcagaaatctgaatggcagcatggtcacagacactggctggctgaggacttcgagactgttgtggtactttctcaaggcttctgttcccttactcatcaattagagttgacaatggacactgatccctgtctctcctgtggattcactgctacctggagtcaggagaagggagcgggaagcagtcaaatcctttagggccttagttcttgtggaccaacatgttaacaagtgcagctgtcccaagctctttgttactgtggtaggcagagcaatgcccctcaaaagctgttcccatcccaggccatgaaaccagcgaccatgttacatatgtggcaatgaggatatgcccctgcattgaggtgcggctctggagatgtcctgtatttcacaggtgggcccaagatgatcacaaagttcctaaccagggaggcaggagggccaggtcatagaaagagaggtgggcgtggaagcagaggttggagtgatgtggctgtgagctggagaatgtggacagcttctagaagctgagatggtgaggaacagtctccccaggagcccccagaaaggagcacagccctgcagacaatgtgactttagccagacagacccatttgggatttctcgcctccagaaatgtagcacaaacatgtgtggttttaagccagtttgtggtattcagccacagcagcaatgagaaacagacataacttccgtgtgattccttgacaggccacgtggctcaggactcctgactccttcctggctttgcttgcttgactgcaagacacagtagggctagacacctgctgcggtctgagtgtggcccccaaaagcatgtgttggaaacttggtccccagtgcaacagcattaagaggtgggaccttttattttttaaaataaaaaggttccatgaggaagagctgaagtaggtggaatctttaagaagacgtgattaggccattaaaactctaccctcgtgaatggatcaatgcccttatctcgggagtgggttagttatcatggtagtgagtacctctctctctctcgctctctctctctctctctcttctctccctccccctctctttgaccttccaccacgggatgatgcagcaagaaagccttcccttaccagatgtcagcatcttaatactggacctacaggtctcaagaactgtgagacataaatttctttataaattaccccatcagtgtggtactctgttgtagtaatacaaaatggactagacaacacataatgttttataaataaattgtatttgtgggatgcttttgtctttctaatctctccaacaaaagacaacttttgcaggcccacttctgtttgcaggccctctgaaaagccatctcaaaatatgccaaagtatcctttttctttttttccagagtccttttttccaatgcaccaaagtatattttgagataaaatatctttggttttctccgctccccactttgaaacttcaaatgtttcacatataaaaaggcaagttgatccctttggagagatttaggttagagtttgttaaataagagacaggcaaagaagagaaatgacaaatttgaatgagcagaaaagaacaaatttaaatattttgtctcagatcttgggacatttctatggaaacagaagaaaaacaaaggttaatgtctggaatagtgtatggactagtttttccagagtcgctgaagcatcttcaaattgtagtggtaatctgacagatttttctgggtattagttggaatcaggtgttccagcaaactttctgagtagtctatacatcaacaggtacaaaggctgtttacatgtaaagttgctacagtgatttctcctaaagtttatatcaagttttctagcatcaatttgcagggctttaagaaaagcacagtttttttatttctagtgattccaagtcagaaaaatgtgagaaaatgtgagaacattagcttggagacttgtagccagaaaagaattcagaattcagtcccagttgtagacaaataataaaaactgaaaaacaatggacagggctagagtagaatagtgggtatactatagttttcttctgaaacataacttttctctccccagttccccatttctaacaaagacaaatcacaataggaccaatttatttgcaaaataagttttcattttgttataattggcctgattgtttgaataaagtacagaaaaggtggtgattggccattcttttaagttggccttgctggaactttttcataaggaatttcagattagacttttaaaatcctctaaagtctaggaaaccaagccaagtgtttgccatcagactgtgcctgtaatgcctgtagaaattcggtgaattcctctcctcttgaggtcccaatatatcttgaggttcttgggcccttcagaaagtgacattctatacttactccaaggtacagaaccttgtaagggaactgtgtagacaagatacctggccagtctttctgcaaggatttttattagatctataaaatcaactttagttctgctgaataggctcatcatatctgaaaatatgccattcttgtcaaaaccttggtaaaataaccagtgtctcaattttgtcctgttatttaaaaaaaaaaaccaattctcactgagcttatgcaaagaactatattgacataaattaaaaatacttacaaataatttccaaattctagagaaatctgatagagagataaatgtttcaattttgttcaattgttaaaagctatagatggcttaagagaaaaaagttttcttgattctggaaatcaaagcatagaaagaatccacaatgattcaaaccaaagagtcaaaaaaaagttttcagtcctctatcagttcagtcccatgtaattaactcttgttctgcttgatattgggttagcaatcttcaggaacccatcaccttttcttatcagagttctggaagtttttgcctattccaacggtatgatatccaaacttaccataaatctgtatccaagagtacttgtcaaggactttttggtaaatttccttaaagaagaagcaagctttcgactatagtaaatcataaactgctttctgagaagagtcaaagtagaacaaaaattatctgtggatgacaaaagacttaaaataaccagggttagagaaacaattgacaaggaaatttggttatttatgtgacattcagcaatttaatataataatcataattattactgataacacatatgaagacatatcagaattttagtaaccccattccatttaggaacacatattaataacacatttttataactacaactcaaagacatttaaatacaatttttttatgtggccagtctttccatatgatttttgcataccaaataagactaatatgtccctcttggacttccaggagttcttcatgaaaatacttacttttataatttgaaattagatttttggaagttttccaaatatcaacagtttaaaacacttgataaaaaaaacaggatgaatcacaagcaactataaagtaatggtcattcattagtgatgattaccccaagtgataaagattttaaaaaccaaaaacttttactccttgatagaaaggagactctgtttcccaaataatcaaaagacctaatgaagacagcatgaagcaaacaaaatccatctctcccctcttttttgtgcagtttacttacaaggaaaacaaaaatcatttgctatctcttattaatactacatgaaaatagtgtttaaaagagaaaaccaaattctacctttgcaacagtgtattaatgctaaagctaattttaataaaatcttataaacagatcccttcaatctcagttttgatcacataaaataagattttcataaaccttttataacttcttgcattttttctatttttttccccagctgtccattcagttgtatgactttaaaacacctaacagagagaataaaaatctacctaattagacccaggcaaaaaatgtctaaattaaattctgaagatgtttctgttttatttacttttctttttatttatttatttatttttagagacagggcctcattttgttacccaggcttgagtacagtggtgcaatcatagctcactgcagcctccaactcctgggttgtagctgagatgacaggcatgcaccaccacaaccagttaatttttttttttttttgaggcggagtttcactctgtcacccaggctggagtgcaatggcatgatctcagctcaccgcaacctccacctcccaggttaaaatgattctcctgcctcagcctccctagtagctgggattacatgcatgtgccaccatgcccggctaattttgtatttttagtagagatggggtttctccatgttggtcaggctggtctcgaactcctgacctcaggtgatctgcccacctcggcctcccaaagtgctgggattacaggcatgagccaccgtgccaggcctacaaccagctaatttttaaaatttgtttttagagattgaggtcttgctattttgcccaggctggtctcaaactcctgggctcatgtgatcctcctgcctcagccacctaaagtgctgggattacagatgtaagccaccatgtcttgcccttctattttactgtagcaataacttaaaaactatctttatgactccgcatgtagtgcatgcctttaatctcagcactttgggaggctgaggcaggtggatcgcttgaggccggagttcaacacaggcctggccaacatggagaaaccctgtatctactaaaaataaaataaaataaaataaaatgccaggagtggtggcacatacctgtaatcccagctacttgggaggatgaggtatgagaactgcttgatcctcgaaggtgaagattgcagtgagctgagattgcaccactgcattccagcataagtgacagagtgagacagtctcaaaaaagaaaaaaagaagggaaatttctgttttttttggagacagagtctcactctgttgcccaggctggagtgcagtggcacgatcacagctcactgcagcctcgactacccaggctcaagaaatcctcctagctcagcctcctgagtggctgggactacaggcccatgccacaacacctggctaatttttgtagttttgtagagacaggatctcactttgttttgcagtgctggtctcgaactcctggggtcaagtgatcttcctgcctcagccgcccaaaatgctgggattacaggagattgtaccattggatcttttttttttttttaaaaaaggtaccccctcaagtggctcaccaaaaccagtaaggcttaatcaagattatgacttaaccaaggacacatgaggcatctccagagaggtgcacagcagtcctcaccagatccagaaccacctcaaagagagctcaaagaagggaaagttttgctagccacaaatggggtatgacccacatctgccagccatatcttccagggtctcagcctctcagctgaccatctacacacaaaagcctaagagccccgtgtaatccctcaaacagaagatgccagaaaaccaacagctgtctatggaagaggaaaggatcaatgacaagtgggtaagccacaaagtcaaaagtcacacaaatatcaaaccaaaagcgactggcttcccaactgggacctgcacccaggccatggcagtgaatgtgtggaattttaacaacaagactgcaaggtggggccaggtgcagtggctcacgtctgtaatcacagcactttgggaggctaaagcaggcagatcgtgaggtcaagtgattgagaccatcctggccaatatggtgaaaccccgtctctagtaaaaatacaaaaattagctgggcgtggtggcacgtgcctataatcccagctactctggaggcagaggcaggagaatcatttgaacttgggagttggaggttgcagtgagccgagattgtgccattgcactgcagcctgggtgacaagagcgaaactgtgtctcaaaaaaaaaaaaattgactgcaaggtggagtggctggcactgcagattccacaagggacccagggcaggcatttggagcatatgaaggattttagctttgtttcaggtcagacttttgctctttaatctcatcaagaggatttctaaggcaagccatgacactatgatgtgtcttttaatttaatcttccaatgaatataaataaggcagttgtttagaataagaaatctttaaactattttttgtaatttagaggtcttttcaacttaaagaatccatcttttggccgctaatgactagaatttccaataatgttcttattctaacatcaattccatcccacagcctcttcatggaaagccccggatgtggttttctaggcttagagtaggttattaccatttaagaaagacttgtttcctgaagagggcatagaataggcagttccaaagattcctccagtaaaattcactcctggaaacaggctcagatagcaagagacttcttttttattttaactcacagtttttattgattgaagtaataaaataaaaattagcaccttagttcctatttcttgtctattgtttttctttctttttaaaatttaattttatttaatttagttgtaagttccaggatacatgtgcaggcatgcaggtttgttacataggtaaacatgtgccatggcggtttgctgcacctatcaacccaccacctaggtatcaagccccacatgcattagctatttatcctaatactctccctccccaccaccaacaggccccagtgtgtgttgttcccctccctgtgtccatgtgctctcattgttcagctctcacttataaatgagaacatgtggtgttttgctttctgttcctctgttagtttgctgaggataatggcttccagctccatccatgtccctgcaaagcaacagactcttgttgccacacatggttaggatggtgtttgtgtgcacagtgcctctggtgacccacacatttctggggacacccatcacagaccccttaattcatgacactggacagctctcctaggatggaactttcccaggactaaccaggcaacaagggccagaccacaaaaattccttatggatgggacttcttattaagacaaacattcccaacagctggacacattcagaacaaaaagtttgctgcctaaaaccttgtatctcaggttcccaggcatcttcaggctaaacacctgatgggacccaaaaatcacaccccagatggcggaaacaagagacagtgctcccacttgtcacaagtcaaacactccagggcataaaacaagatgagaggggtcctcatctggcttctattttgtttttgttgttttgagactcagtctctcactctgtcacccacgctggagtgcagtggtgtgatcttggctcactgcaacctctgcctcctgggttcaggtggttctcctgcctcagcctcctgagtagcagagattacaggtgcctgccaccatgcctgcctaatttttgtatttttagtggggggggggggtttcaccatgtcagccaggctggtcttgaacccttgacctcaagtgatctgcccacctcagcctcccaaaggactgggagccaccgcacccggcttggcttctattttgaggacccacagcaaagtttgaatgcccatctgatcacagccacagactggctgctcttcaggtctggcctgaacaatgggctggcaggatcttcagcccccattctaccctacaaggccccttttcaggacagaacaacacaggaagaccaagacagacgagaataatcctcccggaaggaagggctctaaacaatatgagtattcacaccaaaaagtacaccagagtcgctgcacccaacactgttcacacagatcctttctcacactaatcaacatcttgcagaggaaaaacgactgatttttaccatctgctcacccagattccacagagagaccggccaggagcccggctggtaagaatttcttacccttctgccagctcgtcaggtcctgggtcccctgactgaagcttccagaaaagcaaaacagctttggtattctgttcaggacaccaaaactgtaggggccaacagaaaacctcccctttgcccttgaaagtttcactgaaaaatcaactcacaactcagattaattagagaaatggcatgcacatttattaatgtgcacatggagaaggaccagagcaatgatcccaaccccgcagtggtgtgcagaagcttatttaccgccttgagactacagaaggaacaggggctgggatgatggcaagacaggttagaggagagggaggaggaggcctggctcgcaaaggtggtctcagaatgcagacagaaccacacagacagcagtcctcagagagaatagatggtaaacatttctttctgatggctaaacatgtcagactctgagggactccttcctagatccagacaagggaaggcttcagaggaaacttgcctgtgtcagtgtggattctctacagatgcaaacgttcccctcaaaaggcagctttgcagggtggcctctgtttgaaggcccctctaaagagccatctcaaaatatgtccaagtatatagtggggtgaaatattttggtttccttcaactacatccttactacttaattcaatgcaatttcccttagccatgaactcttcaagtctttttttgcctgaaaaggttttgattgaattcataatcttgagtgatcaccatgtaagcagataaatattggttgacagttatatttcctcagtatattaaagaaacctggctcggtgcagtgactcatgcctgaaatcccagcgctttgggaggccaaagtggtgggtggatagcttgagctcaggagtttgagaccagcctgggcaacatggcgaagccccatctctccaaaattacaaaaattagccgggtgtggtggtgcatgcctgtagtcccagctactcgggaggctgagatgggaggatcccttgaacccaggaggcagaggttgcagtaagctgagattatgcctctgaactccagcctgagtgacagagtgaaactctgcctcaaaataaataaataaatctttccatggttgtgtgcatgttgagatatctgtcttgcctaaatttatttctctattttttcctatcttttattttgatgtaatttcagacattttaaaagtcacagcctggtgtggtggctcatgcctgtaatcccagcacttagggaggctgaggcaggtggattgcctgaggtcagtagtttgagaccagcctggccaacgtggtgaaactccacctctactaaaaatgcaaaaattagctaggcatggtgggcggcgcctacaatcccagctactcaggaggctgaggtaggagaattgcttgaactcaggagacggaggttgcagtgagctatgattgcaccactgcactccagcctgggtgacagagaataaaaaatgaagagttcatgtcctttgtagggacatggatgaaactggaaaccatcattctcagcaaactattgcaaggacaaaaaaccaaacaccgcatgttctcactcacagatatgaattgaacaatgagaacacatggacacaggaaggggaacatcacactccagggactgttgtggggtgggggaagggggcagggatagcattaggagatatacctaatgctaaatgatgagttaatgggtgcagcacaccaacatggcacatgtatacatatgtaacaaacctgcacattgtgcacatgtatcctaaaacttaaagtataaaaataataaaatgaaactaaaaaaaagagttgcaatagtagtgcgaaaaattccatttatgattccttcagattcctctcatattaacattcaattacatttgctaaatgctcttctcttggtgcagatgtagaatattatagctattttcctagaccctgtgagagtcagttgcagacatgatgctcctttacctacaagtattgagcgtgtgtttctgaaaccaagggcagctcttacattatcagagttcagtgatcaaaaacaggaaatcttcattgacacaatacaattctcagaccttcagatctccttcagattttgccaacggttccaatattgtttttataggggaagaagatcctgaaccatgccttcattcagttgtctcatctggaactgttctgcaacctctttgatttcttgatattgatgtatttccagatacaggctagtcacttaatagaacatccctccatttggttgcctgatacgtcctcacgttgagaatcaggttttgcactttcagcaggaacactacagaggggatgctgggctttttcagtgcaaccactaacaagaaacatgaagccagtttctcccctgctgtgagggtgaggtgggctttctccctggactgcaaccacctgggtgagtgtgttttataaaattatgctttctccactgtaaccttctcccatttccatttctgagtgcaaactatcttgtgggtggttacttttgagattctgggtctcttaaacactagttttggttgatttacttcagtatcacaatacttcagcatattatctactttcatttattcttggcactcattgtggttctggaatctaaagatcaatagttttcatcagttccagaaattccttagccattatccctttgaataggaccgttctctcattatctgcattttctcctcttgtaattattgtcaagtgtgttttgcatattctcatttcaattctccagtctcctgatgatctttcacagtttgcaaatctttattgctatatattctagacaattccacatatggatattcttataatttctatcatcatctgaggctaatctgttgtgttttaatttttaacttcactgatttcactattcacttccagaagtttcccttggtgtttcaaacaagcctgtcttctgtggtggcaatgtggtattttctagtgactgcagccattcttacctatctttaatccttttaaacctagttaaaagattgccttcttccttgttccctctgaatgttatcagcttcacattgctaaggtttttgaggtataattgacaaagtgaggtgtaattgctttattgaagtatagttgcctaagattgtatacatttaaggtgatgtgatgatcacagtgtgatgttttgatctatgtatatattgtgaactcattaccacaaccaagctaattaacacatctgtcacctcacacagtaaccttgtgtgtgcctgatgagaaccttaagatatgctctcagcaaatgtcaagtattattaactatagtccccatgctgtatattagattctagaacttattcgtcttgtaactgggagtttgtgcttatttatttatttatttatttatttatttttgagatggagtctggctctgtcaccaggctggagtacagtagcatgatcttggctcactgcaacctccacctcccaggttcaaatgattctcccacctcagcctcccgagcagctgggattacaggtgcacaccatcatgcccggctactttttatatttttagtagagacgaggtttcaccatgttggccaggatggtcttgaactcctcaccttagattatctgccctttttggcctcccaaagtgctgggattatgggtgtgagccaccgcacccagccagaagtttgtactttttggtcaacatttccccatcccctccactcccagcccctggcaacccctgttcccctctctgtttctgtgagttcaatttttttagatttcacatctaaaaacaggagttaggggagattgtgcaatacagtcaacccttgaacaatgtgagagttgggggtgctgacacccccatacagttggaaacgtgtgtataacttttgactccccaaaaacttaactattagtagcttactgttgcctggaagtcttatgtgttaatgtaaaccacagattaatacattttttatgttatacatattatacactgtgttctcatggtaaagtaagctagaggaaagaaaatgttattaagaaaaccataaggaagagaaaatctgtttactattcattaagtggatcatcataaaggtcttcatcctcatcatctttaggttgaggaggctggggaggagggagaagaggggttcatcttgctgtctcaggggagacacaggcggaagaggtagaggaggtggaagagaagaggcaggagaagcaggcccccttgctgtaactttttttgaggaaaattcacgtataaatggacccacacagttcaaacctctgttgttcaaaggtcaactatatctgcctttcggtgtctggcttatttcactcaacataacttcctctgggttcatccacagtgtcacaaaaggcaggatttccttcttttttagggtgaatgatattctattatctcattatatgtacatcacattttctttttccactcatccatgtgcgtacactgaggaagttcaggaaattccttccccgcaaccagaatatgccagtttgatgtgttgattgcttcaaactgagggcagtggtggaggagcaaatgcagggagggttttctgtggacctccctcatctgttgaaagacagatcttccaaagggaactcagctggcatgaatccccttcctgggaacctcatcaacaagggaagatttgttcatgtcacagcagcacagacagactttgtcactgctgtccctttttcattcttcattcttccggggatacatttatctttcccccaaataatttactctccctttggttgcctttgtcccctctctttctcccctttgcagaaaagtacataagcttccagcctcactgggtgttgggtttcacttttctttcacgtgatgcctcccgtgcccacatgtaaatttgtaagccttattctcctgttaatctgcctgctgtccattcatctcacagactcaattatcgaaccctctgagggtagagggaaagcgtttcctccccacaacacctgggttgattcagtatttcagctattgtgaatatgctgcaatgagcacggggatgcagacaactcttcaacaccctgaatgcatttcctttggatatatacccagtaatggagttgctggatcacatggtggctctatttttagtttcttgaggaacatccatgctgattttccacagtggctgtactaacttacattcccaccaacagtgtacaagtgacactgtactgtggtctgttataccctccttttctggctttcacattttgtctgtggtgcactcctcaaatgagttccgtggcatgccttgttcctgttttcactggaacatactgcacgctatgaggattatttcttcgtggaggcctggtcatacttggttgatgagcagaaggaccatttgccttttagaagcagatgtttgacttcaagtttaaaatcttctgtaattactgatcaaattaacatctccacaatactagttaacacttttcttaaaacgtcttttgtttcctaatactttttctacatttttgcacaaagttatttcattttaattactcttaatttactttaattttggaagtgagctttcttttcaacaatccataaatggttttttattttctcttttttcttgttcatattttcccaacattgtcccttatatatttccgtatagttaaccagatttatttcttatcaatctaatttgttttatattttaatcaatttatcgtttaccattatgaatttcttttttttcttactttttcttttgaaacagagtcttgttctgtcacccgtgctggagtacattggtgccatcttagctcacttcaatctctgcttcccaggttcaaatgattctcctccctcagcctcctgagtagcttgcattataggtgcgcaccaccacaaccagctaatgtttgtatttttagtagagatggggtttcttcatgttggccaggctggtcttgactcctggcctcacatgatctgcccacattggcctcccaaactgctaggattacaggcatgagtcaccacacctggccattttatcattatgaatttttgttctactttttccttttactttttttttttttttacagattttagtcttgttccagtttttgtttacctaacttcttcagttaaagttggcttattaaaatgttaaatttcttaggaaatggtaatctttggaggttaaaaagatttaaatttcttattattctcacaatgcacctaaaactatacagctacacattttttctcttagaacagcttctgttgtattctgaatatcttcttatgttgtactttcaatcctagataccttcttctctaaacttggtggatcttctgaaagttggagcagaatgggctttatagtttaaaaggtccactgctgtccagggatgtgaattctttgaggagggagttactgcacaaggaggtcgggagctgacggagtctgatgacaaggccctgggatgtaggagagggcacaaggcacagcaaagccagcctcactgcatgtccctggagcctgtgccaggtctacttcctggctgccagcttttccacaaatgctgtgtgcacctcacactttcagatcaggccgaaagatttctgtaggtcatgccaggaaagggaggttaagcaggcagctgtctaaggggtttgggggaagcttgggggagtcacaggattttgttgaagagagagaggtggaggagatggggctgtgtgttggggaggaaggttcagactggagatctagaaatccattagatcctctggtgggtcagggacaagagttgggggtgttgggggtataagtgggtggagaaggaggatttatggtgggagtggatttcaacgtctgctctaggtcagcttttggctccttaattttgttaagggatgttttaagactaaccatagtacattctgtgttcctctatcagtgtgatcttcccatagatgccagcagaccagttgtttagaacgagtactctctaacatgttttaaacatggatccgtctctggccatagctgatttggatctgcactggtgcatatgttccagtagtgccttaatctgcctttccagggaaaggccaggaggtggctttccatcattaccagcatgcaaggggtgttcctgcagtaggtgcagaagaggcagcccgtgatccaaaaattcactctcagagatggatgaagaaagcaaagacttacattgccatgtgcaggtagggagagtgtttgtgcagaccacgcctccagtctcccatggaagctgagacaccttcagcctcaggtccactcactgtgacactgggcaggtgatgctggaataggagtctcccagcactaatcagggcaacaaggataagatgaagaaagcccttatgaattggcatcttacaacaaaactccgtgagcgcttgacacatacagacagagagagtgccacctgggtctcatgtgtcttgagtccccagtctggtcagactgctgcctggcacagagccacactctgtgcccctccgatggcagagaccagagaggcatcctccttggtcacacagccaagctctcaggacataaaacgaggtgagaggggtaccccatcccttttgtttttttgtttcagggacccacagcacagtttgcttaggcagacatgggtctgacaagcacaacaaacccaagtgctggggacccagcagactttgaaggacctgtgcctgtgttctctacccgacacttcctctccttatgacaaacggcagaaaaagacagagacaaaggaaaacaaagaccatctttgagatcaaaaggatcaaatagaaatctaaacactaaaagtccctttttacccaaagaactatttcacaatgttttatcctgtcaatcccaatttagagagagaaaaagacacaaatctcaccattctcacctagatcagccccacagcagagacctggaaggctagcagtaagaaccctgcctttgctggcttaggtcagaggtcccgggtcttagctgcagtatctccagaataagcaatttcccagtcagtgagggagggccccggactctgtgccacgttctgcagggacccagagatcacctccaaccccacttagctcttacatgggctcctcagctggatctagaaaccaaattgaaatcaagcatattaacaagagaaaagcatacaaattgtattagtattaaaggtacatggggatcttcccaagttagtgaagtctgaagtagccaaagcaagatgcttttgtactttttagacagaatgataaatttgagaagaaatgacaaggccaagcagaatctggctaggggcagtaaatttccaggggagcctctaggtgatatgcgggaatataaaatcaatggcaacaaggcttacttcatgaagtacatttacttgggtcagttgctgcccccaatccccagtctccagtgctaagggctctcttcttgcccttgtgtgggggtgccacccccagaggagtctttatggcttgctacatgcaggaagaggcaggtcagctcaccctttctaaaactacgatttctccaatatttttgacataaaattatcaatataccaatttggcatattttgggatggcattcactccttcaagggaaaggtgggatggggaggtgtggggtcaggtgaggatgtggtgaaagacaaggtggggtatggatggaaatgggctctaggggaagagggaacaggcatggaaggggtgaggagagagagggccatgagccatgggtctggaggcagagagggaggcactggtgcaggtgataaaacctcacatgaggggtggcacaggtcagggggaaggtggaggccactggtgaggagactgggggttggcattgacaaatccacagatcccaaaggtgatggggaacagcagcgtcttccccggctccccacacagcagcatgttggcctccagatatactccatcacccccctgggcagggctcacacttctgacacccagactctacaatactcctctgtccccacccagggcagatccctaccctagaagttctccctctcatgtctggtaaatgctgcacagagccctggaattccacagggcaagttaggaagagggacagctgaaatcaggaagtaatcaccttctccaaagagaagttcagtccagtaccatcttgtgcccctgggcaagctctccaggctgagggaacaggagcagtggttatgctgggcaaagttggaagcaagggacctctcaggaagtgctgtagaatgttccactggggacacctcgtaccctaccaggattagaccttgaaacctggagatcccaggcaattagtattcaaggtcaaagggccagtgacaggaataggaaggcccactgtgtcattcacaaagcacttccaaacccatcaccccaggtgaccctcacaacaaccccgtgagatctgcagggcaggggctcccacaaagaaggagtcaggaatgtcgggattttaacaccttctccaagtcaggaccaggaaatgctgtcccagcaccaacttatattccctaggcttcctcccacaccacagcttagggtgactgccacctcatgggcagagaccctagctttccaatccttacaaggggctgtgcaggggagaggatgaagccccctcctctgactgtctcctctaagagcctgttttctgatgaaagtcactctgggaactgtcagcctctgcaaatgggggcctggacctcgtggaaagaagatgtgaaggtcacacctggcagggaccagctctggagggcaaacctcaccttttaaaattcccaacttgcatgtcctcctgccactgcattggtgctgacttctaaaggagcagcggacgtgaaaaagttgactttcttctaggttaacttcatgaagattattaaagtgatgaaaatatttatcctattctctataaagctccagcgaatatggttttctgcacatgcttatcaaagaatcttttagccaggagccctctgctgaagaacagtgtacaatctcagctgggacgcacatgttgcttctggaaacagatgaacacagtctgatcagagtctttcatgggtcagcgttgctccaggccagcccagcacagtcaggagcctcggcccaggcacgcccaagaagggagggtggctagtgcccagatgctgggggactgctcttttcgggtgctcttaattctgttaagaagccaatccatggccccgatgtcgtggtgtttggggctttaccctggcatcctgaacacacccagatagctgggtgtgagcactggagagaagccccggtctccactccacctcctgccctgcccaagctgctcccctggactgatagtgttctagtctctcctgagcattctcattcctggggcccctggggtccaatagtcaatttaggagcccatctaaagagactatctcttttagggggctggctttagggttcccttaccgatgaattggtaaatatggatggcagtggatgtagttgcatgacagaaagcacatcccaaccccacacaaaataatgagaaatggaaccaaagtcccagggctctccaagcacagaagaagccaccaaatattctccatctccatcatctgaagtgagctgatgcctcggcagctgggtgcagataacatgcagctcagtgcagagctccaggcccgcatcacaggctgtggaagggttacagattactcttgtgctcagaaggagacaaaacaatcagctctcccactgatcccaccccagcaggcccagcacccctcccagcttccaggccccaccaccctgctgccactacctattttctgtctccaaatttactttactgtaagttccttttcactctgtccatgacccagacataagcagggattccctcagagaaacagacttggatcccagctttggaggtctgaagatctccaggaattttttctaattctcaggcattaaaacaaatttttttggaagtataacatacagatggaaagcacaaatatcttaagcctacaatgcaatggattctcacaaacagtacactatgagagttgaactcacaccagaaaatgggatcaccccaggacctggaagcctctctagggcccctttcaagacatcacctatgccccgccccccccaccaaactttcctgacttatgattttccaggaacaattttatagttttcctgtgttttcactcaactaacatttacagtaatcctctgagataaacactgcactatcccccgttgcagatgggaagctggaagcacagacactggttattgatcaggtgcccactgctaagggtggagccagggtcccacgtggaagctccctgcagagccacattcttgaaacattgaactgcgctgcgaaaagccctttggctgcctgggcacagtggctcacacctgtaatcccagcgctttgagaggccaaggtgggatggttgcttgagtccaagagcccaagaccatcctgagcaacataacaagaccctgtctgttaaaataataataataataataaaattaaattagtgggtgtggtggtgcatgcctgcagtcccagctactcaaaagctgagatgaaaggaaaaaaaaaaaagaaaaaatcccttggcaagcaggaacaatagctcagttcaatgcaattgggtgtgtagaagaatcaccaccaagctctgggaaggctaggcagagggttttgcacacactcagggagtcctgtcctctctactgtggttggaacctgagaggggctgtgaggctctgagcaggagagagacttgcccaaaggccaaagacagggaggagtagagtctaacatgagtacaagattgactaggaccatcgtttatctctttacacaggaacaggaggaacttgaggcaaggaagggctatataagatgcagtcccctccctgcaggggccagcttggtgctggatgcatggttggttttatagtgacttgaactctgggactgcggcaggtggggccagatccttgactgtgcaggaatagacctcttccctgaaccgacagatgctgtatgaggaggggaggagggctgggaagccagccaggctggggtgggtgggcagagagtgttggggtttctcacctgtcctaacaaccacaaccacctttctggccttagaaagaggcaacagggagtgtgcgttttgtagagttcttcagggctgggcagagcccctgaggagatttgttgggggtggaaggacagaattcagatgaaggagacttggaaaaatgagttttaagaagttttattgtgggttatgatttcgataatgattagaattgcgtttcagggtgggcatggtggctgatgcctgtaatcccaaaatttgaagaggcaaatgcaggaggatcacttgaggccaggagttcaagaccagcctggacaacatagcaagaccccttctttgcaaaaaaaaaaaaaaaaaaaaaaaaaattgaaaattagccgggcatggtgtgacacacacctatagtcccaactagttgagaggctgaggcaggaggatcacttaagctcaagagttcaaggctgcagtgagctatgatcaaccactgcactccaacctgtttccaaaaaaagacaagaattacatttcagtataatgaaatcataatttttaaaggtaaatactataacctttaattgagagagaaaaagagtttgacagcttcaaacttgatactggcataaaaataaacaaaatagcccaaaagtccttgtaaatattcatgtatatataggaactgataacagaacaaaggttgttttccaaagaaatgagggatggctcacaggttcattgagtattgttgaggaaataggctatccatctttgcaaatgctcagattattcctaccacacaatatacagaatctagttgctgtataaggaagaagagggtggctctgggcagacacctgtgtttcaatcccagttttgctctatgcacctctatggcctagagaaagttaccctacctctctaggtatatgctatccagatcttaagcgggtttaagaaaatagctaggctggtcatggtggctcacacctgtaatcccagcactttgagaggcagaggtgggagaattgcttgaggctaggaattcaagaccagtctgggcaacacagtgagtccctgtctctacaaaaataaaaaataaaaattagatggcatggtggtgcataactgtagtccaagcaactcgggagtctgagacaggaggattgcttgagcccgggagttcaaggccacagtgagctatgattgcaccactgcactccagcctgggcaacagagcaagaccctgtctcaaaggaaaaagagagaaagaaagaaaggtagctaaatcatagaatggttctgataaactgggctctagatgtgaagaccttagaacaatgcctggcatgttcagtaaatactatttccccatatccgtctattaatagcacgctaaacataggaggagaaggccacacaagcaagtgggttacaaacttctggttctgggtaggactcaggagcagagagagatagatgagggatgatggaggatagcagtggactcactaagattgacttcctggctcaaatcttggagaggaaaagggaaaatcccaaaggactttggccatgggagttttgctgctagtattccagggcatgtcctgtgattcatgctcgttaagacaaagaattttatagcagttgccatcccagaaaattcctattccagcttccctgggccacaggtgagacagaggctctctaaagtcaacccgcaggtttggcttcttccatttacctgtgccctttctttcaacaagaggcctccaaggctgccacgatggagaaaagaaatggggattacacaggagacagttctgtgagccaagccccaaagcggcagcctgagcttctgcccacatcataccgacaaggactcagtcctgtggctcctgctactggcagggaggtgaagtttccctgatctgcaagaggaacatgagtgggttaggtgagcaatagcactgactgcaccagcatgccttcaggtcagcagattatcatatttctgttgccactacacaccaataaaacagaaactcactctgtctccaaggtggccatgcaaaggactctctagtaattccatcctgctcaaagctcaggaccattggctcacacagagtcctctccaaagcagcaagatgtggccctgtgcagccaggagacagaataataacctaattcccattcagaacatgcagaacatggaccaaggagaaacacagaataatttgtgtagcctacggggctggcaatgggaagatagtaagaatgttttccttgattggacatcaagtctgctctctggaattaagtccattttcattttgttttctcctcttgtgcctggctctcctctccaaggaattcatcattgtctgttaccatcttggtcacttctgaagtgggtttgggggaaaaagtctctgtgggagctgcaagtttagcagcctacttccttgcaaagatggtaccaagacttgcctatgggtccaatggttttagatcctgctctgcatttagacaatgctcatagctgctttgcaagccaccccaaaccttggttaactcacatccctgtgtttccagtcagttccatgagccaattaccacaccccaaaggcctttctttcttggacataattctcaagactgagccttggtagattggacttctaaaatactctcttactacttggggtccagaagcagcaaggtttttccaccttacaaagtctgatgtttctggattctcttgatttctttttagttatacttacatactgggaaaattattgaactcatcttcctccaattacttgccaaatgcatttatcaatatagaacacacactactaacattgtttatcaaactcttcccttatagtcacaagttcagcagcaggtgcataatctgccatctaagtaactgcaagtgatgactttaccaaaggctttgttatcacttaagatggattcagctttcattagaattattcatcaaaataatataatacaaaaaccaaataaaatgtggctacaccataaattttggtaaatgattagcaaatataaaaattaaaaaattttggaacgcttctcttaatgagacagatggacttctgtcccagctttgccatgaatctgtgaatgaacagttacctgctagaatgtgacagagttcaacatcagtcatacacctattttttcacttgttcagtttgaagtcctgagaaaccttgcttacataaataagcagataggaatggaaagggtctttatgcaattatttgaactctttcaaagttatagaccaaaaagcacagttatatataataaaagttattgtaaatgacccatctgctgacaactggatttgttccaccttcagtttgttcaaatgaagaattgaaacttatgtgactcgtagtgggatttgatatccaggaattaaagacagtctcacctgaaatacctacttcagtattttaaattatccccttgttaatccctggagatatggatctatggtctatagtaagatgcaagattgttgaaagggaacctcttgtgaagtgggagaagggctattctaaatagggactctttgatctcatgctagatcttaggaagatcatattttggaaacagcccaggtagaagttaaagatctgaaaattaatttctttaaaaccatccatgggaaagttctgagttaggaattccaaaggcctgccttctaccaaaacagtgaaaccactggcaaaaaactgtcaaaatcactctttatagaactctggaaaagcttgcagcaagcagtagagcacatattcaagaaaaactgctgacaccaataagaaaagcttgctccagggtgctttagcttatcctggttccatctcctgcttcccttgaaaactcacagctgttgttcccagtgtggtactgaacagatcagaaatgaagatattctcagagagttggaactgctcattttgatctgtcagattgctccccagaagactagctccaaaggattgccattctcttgtccaccttggaactcaccccaaactgaagcaccacctcagagcaattgttgacaacatatatggcaaatgttccaggcccaactgccaaagggaatggacagttgctggggaaaacaacaggttaaccaaaacttactgggagaaaagtctggaaataagatgttttaggcaacaagggctttggaaaattgttacaaattcctgggaatcttgaaggccgcacacatgcccagggctctgtgcaccctcagagaagagctcagacagctctaagctcacccttggctgatcatgaggttcaacacaggcaggaagtgaaggttaagaccaggttggaaaccacctggctgagcattgaaggaatgacctcaaaatgcaaacacttcctctgcaaagattagatttttattttattttattttatttctttagacagagtcttgctctgtcacccaggctggagtacagtaacatgattatagctcactgcagcctcaaactcttgggctcaagtgattctcccacctcagcagctgggaatacaggtgtgtgccaccacactcagctaattttgaattttttgtagagacggggtttcacgatattgcccaggctggtcgtgaactcctggcctcaagtgattcacccatctcagcctcccaaagtgctggcattacagacaacagccaccgcacctggccaagattagattttttttttttttgagacggagtctcgctctgtcgcccaggctggagtgctgtggcacgctctcggctcactgcaacctctgcctcccaagttcaagcaactctcgggcctcagcctcccaagtagctggaactacaggcacccaccaccatacccagctaattttttgtattttagtaaagacggggtttcaccatgttgcccagggtggtcgtgaattcctaagctcagccattccacccaccttggcctcccaaagtgctaggattacaagcatgagccaccattcctggcctaaaatcagctcttttaagtatgtccaaagagctacaagaaaccatgttctaaagaactatggtgaggacgaaaacagtatctcaccaaatagagaatattaacaaagagatgggaattataaaaagaaattcagaagttaaaaagcacaataactgcaatcaaaattcaatggaaggctcaccagtgcatttgatcaggcagaagaaaagaactgacaccatggtttaggtcacagcatcccagatgctgcaactagatttttcctttcttaggaaccttggggtccaagggttgtagtcccactggtgttcaacaacacacggatcaatgtgtgtccatgcagtacatttaattccgaacccccatttgggggtactgtcaggcttatagatgccttcatatacatacattatgagatgctaggatattcctgctgctcattactaggacagagctccagctgccatttcaacaaaaaatcccaaaaagtcaactaaattcaacgccttcatctgcactcaatgagcctgtctgcccagtggggattgtggacagagcagaagcattatgacacgttacgtgttggggtttttagtgctaagtttgtgtgatgagaattgctgaaccctctgatgtggggtgagtcattaaattgtctcccctgccactgaatagattccaacatagcctggccacacgtccaagggtgtgggggacagagggggagccgaagcactgatgctccctgatcctttgatcagtcaagatgactaaggtgggtgcacacagaaggcgggggcaggaaagtgctggggtggatgttggagaaccgacactagtggagctaacccaaaatcactaaatcagggatttcagatggcgtctactgttagggagatgagaatcctcatgtgagatgagtcaggttctcctgggaattgccatggggcagggggttgggggggagttaaatggcactcctgaacactagggctaattaataataaagccctatatttccattttactgccaatcacatggagacataaacatcttcctgatgggagccatagccaaagcctttccacttgcaagagctccgacttcccttcagtgcatgcgggttgaccagggagactacaagagggggcaggggtgagattcgtggcaggtgagcctgggagcagagcagagagaagcactgttgtaccatggcttctttttccaattttgctttttttttaaattatactttaagttctagggtatatgtgcacaacgtgcaggtttcttacatatgtatacatatgccatggtggtgtgctgcacccattaactcgtcatttacattaggtatatctcctaatgctatccctctcccttccccccaccccacgacaggccccagtgtgtgatgttcctcttcctgtgtccaagtgttctcattgttcaattccaacctatgagtgagaacatgtggtgtttggttttttgtccttctgacagtttgctgagaatgatggtttccagcttcatccatgtccctacaaaggacatgaactcatccttttttatggctgcatagtattccgtggtgtatatgtgccacattttcttaatccagtctatcgttgttggacatttgggttggttccaagtctttgctgttgtgaatagtgccgcaatggacataagtgtgcatgtgtctttatagcagcgtgatttataatcctttgggtatatatccagtaatgggatggctgggttaaatggtatttctagttctagatccttgaggaattgccacacagtcttccacaatggttgaactagtttacagtcccaccaacagtgtaaaagtgttcctatttctccacatcctctccagcacctgttgtttcctgagtttttaatgatcgccattctaactggtgtgaggtggtatctcattgtggttttgatttgcatttctctgatggccagtgatgatgagcatttattcatgtgtctgttggctgcataaatgtcttcttttgagaagtgtctgttcatatccttcacccactttttgatggggttgtttttttcttgtaaacttgttggagttcattgtagattctagatattagccctttgtcagatgagtagattgcagaaatgttctcccattctgtaggttgcctattcactctgatgatagtttcttttgctgtgcagaagctcttcagtttaattagctcccatttgtcaattttggcttttgttgcctttgcttttggtgttttagacatgaagtcctttcccatgcctatgtcctcaatggggggcattgcctaggttttcctctaggatttttatcgttttaggtctaacatttaagtctttaatccatcctgaattaatttttgtctaaggtgtaaggaagggctccagtttcagctttctacatatgactagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggctactgtagccttgtagtatggtttgaagtcaggtagcgtgctgcctccagcttttttcttttggcttaggattgtcttggcaatgcaggctcttttttggttccatatgaactttaaagtagttttttccaattctgtgaagaaagtcattggtagcttgatggggatggcatcgaatctataaattaccttgggctgtatggccattttcacgacattgattcttcctatccttgagcatggaatgttcctccatttgtttgtgtcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcttatcagcttaaggagattttgtgctgagacaatggggttttctaaatatacaatcatctcatctgcaaacgggacaatttgacttcctcttttcctaactgaataccctttatttctttctcctgcctgattaccctggccagaaattccaacactatgttgaataggagtggtgagagagggcatccctgtcttgtgccagttttcaaagggaatgcttccagtttttgcccattcagtatgatattggctgtgggtttgtcataaacagctcttatgattttgagatatgtcccatcaatacctaatttattgagagtttttagcatgaatggttgttgaattttgtccaaggtcttttctgcatctgttgagataatcatgtggtttttgtctttggttctgtttatatgctagattacatttattgatttgcctgtgttgaaccagccttgcatcccagggatgaagcccacttgatcatgatggataagctttttgatgtgctgctggattcggtttgcagtattttattgaggatttttgcatcaatgttcatcagggatattggtctaaaattctcttttgtggttgtctctctgccaggctttgttatcaggatgatgccggcctcataaaatgagttagggaagattccctctttttctattgattggaatagtttcagaagaaatggtaccagctcctccttgtacctatggtagaattcggctgtgaatctgtctgttcccagatgtttttttggttagtaggctattaattattgcctcaatttcagagcctcttattggtgtattcagggattcaacttcttcctggttaatcttgggagagtatatgtgtccaggatttcatccatttcttccagattttctagtttatttgcatagaggtgtttatagtattctctgatggtagtttgtatttctgtgggattggtggtgatatcacctttatcattttttattgcatctatttgatacttctgtcttttcttctttatcagtcttgctagtggtctattaattttgttgatcttttcaaaaagccagctcctggattcattgattttttgaagggttttttgtgtctctagctccttcagttctgctctgctcttagttatttcttgccttctgctagcttttgaatgtgtttgctcttgcttctctagttacttcaactttgatgttagggtgtcaattttagatcttttctcctttctcttgtgggcatttagtgctacaaatttccctctacacactgctttgaatgtgtcccagagattctggtatgttgtgtctttgttctcattggtttcaaagaacatctttattcctgccttcactttgttatgtacccagtagtcaatcagcagcaggttgttcaatttccatgtagttgagcggttttgagtgagtttcttaatcctgagttctagtttgattgcactgtggtctgagagacagtttttataatttctgttcttttacatttgctgaggagtgctttacttccaactatgtggtcaattttggagtaagtgcgatgtggtgctgagaagaatgtacattctgttgatttggggtggagagttctgtagatgtctgttaggtctgcttggtgcagagctgagttcaattcctggacatgcttgttaaccttctgtctcattgatctgtctagtgttgagagtggggtgttaaagtctcccattgttactgtgtgggagtctaagtctctttgtaggtctctaaggacttgctttatgaatctgggtgctcctgtattgggtgcatatatatttagggtggttagctctttttgttgaattaattcctttaccgttatgtaatggccttgtctcttttgatatttgttggtttaaagtatgttttatcagagactaggattgcaacccccgcctttttctgttttccatttgcttggtagatcttcctccatccctttattttgagcctatgtgtgtctctgcacgtgagatgggtctcctgaatacagcacactgatgggtcttgactctttatccaatttgtcagtttgcatcttttaattggagcatttagcccatttacatttaaggttaatattgttatgtgtgaatttcatcctgtcattatgatgttagctggttattttgctcattagttgatgcagtttctttctagcatcgaaggcctttacaattcagcatgtttttgcagtggctggtactggttgttcctttccatgtttagtgcttcctttaggagctcttgtaaggcaggcctggtgtcacaaaatctctcagcatttgcttgtctttaaaggattttatttctccttcacttgtgaagcttagtttggctggatatgaaattctgggttgaaaattcttttctttaagaatgttgaatattggcccccactctcttcaggcttgtagagtttctgctgagagatccactgttagtctgatgggcttccctttgtggataacccaacctttctctctggctgcccttaacattttttcctttaattcaactttggtgaatgtgacaactatgtgtcttggagttactcttcttgaggagtttctttgtggcattctctgtatttcctgaattggaatgttggcctgccttgctagattagggcagttctcctggataatatcctgcagagtgtttttcaacttggttccattctccccatcactttcaggtacaccaatccaatgtagatttggtcttttcatgtagtcccatatttcttggaggttttgttcatttctttttattcttttttctctaaacttctcttctcacttcattttattcatttgatcttcaatcactgatagatttcttccagttgatctgaagcttgtgcattcatcacgtagttcttgtgccatggttttcagttccatcaggtcatttaagaccttctttacactggttattttagttagccattcatctaatcttttttcaaggtttttagcttctttgcgatgggttcgaacttcctcctttagctcggagaagtttgatcgtctgaagccttcttctctcaactcatcaaagtcattctccatccagctttgttccactgctggcgaggagctgcattcctttgtagggggagaggcactctgatttttagaattttcagcttttctgctctgtttttttccccatctttgtggttttatctacctttggtctttgatgacggtgatgtacagatggagttttggtgtggatgtcctttctctttgttagttttccttctaacagtcaggatcctcagctgcaggtctgttggagtttgctggaggtccactccagatggtatttgcctgggtatcagcagcagaggctgcaaaagagcgaatattgctgaacagcaaatgttgctgcctgatttttcctccggaagcttcttctcagaggggtacatggctgggagaggcgtcagtctgccgctactgtgggatacctcccagttaggctactctggggtcagggacccacttgaggaggctgtctgtccattctcagatctcaaactctgtgctgggagaaccactagtctcttcaaagctgtcaggcagggacatttaagtctgcagaggtttctgctgccttttgtttggctatgccctgcccccagaggtggagtctacagaggcaggcaggcctacttgagctgcggtgggctccactcagtttgagcttcctggtcactttaccaactcaagcctcagcaacggtgggtgcccctcccccagccttgctgccacctcgcagttcaatctcagactgttgtgctagcaatgagtgaggctctgtgggcatgggaccctccgagccaggggcaggatataatcttctggtgtaccgtttgctaagaccattggaaaagcgcagtattagagtgagagtgacctgattttccagtgtcatctgtcatggcttcccttggctaggaaagggaattcctgaccctttgcacttcctgggtgaggcgatgcctcaccctgcttcagctcatgctcggtgggctacaccaactatcctgcatccactgtccaacaagccctagtaccagtacctcagttggaaatgcagaaatcacccatcttctgcatcactcatgctgggagctgtagactggagctgttcccattcagccatcttggaatcgccattccctttggcgtctttgtctctgctctgctttgcctgtatcattatggactatccctaggggagaatctggatgaacacaggtggtggctgagttctccacagcccacctgcagtgagtgaggacctgcctcttctcctgaatggtacctctttaaccatcagttgggcacatttgtctctcagcctggatcttctaaatgtgtccaagaagtcttagtgccagttgtttctccaggactgtgggaggctgtggcagctcaggggctgattgggagatcatctcttttccaacctttccctctatgagttccaacttccatgaagcctgtgtcttctcagaagagatgggagaggtttctttttctcatccagcccacagcctcagcaagggatcgcccatatcagtggctatcatgggcccaggcatgaggtgaccacaggagttggggctgcatgagacactcaccttgcagttggtggcaggtgtgtcctcaggggagtcctgtcagccagcactccaggtgcgggatgcagggcagggcagccttcaaggatagcagaagagtgggttgggttggagagggcaaggaggaatcacttatgtatgctccctagttttaaacctactaaaatgtttataggatagacctgaacagtctgatcatttcaaaaggtaaataaaactctccttacaatccttgtcctcaaagtccttagccccgcacacacaggattgtgcgcaatgagggaagctgcacctgccagcccaggcctgtggagttctgggcgttgcttcatcactttgtgtcactccataagggactgttcacgtgtatttgttcagcttcgctctccagaaggcccttcaactattagtccattgtatctctcaactctcccaacagattgttgaagcatttcacagaggaggaacccgaggctcctatgaaggaatagttcacccagagtcatggttgataggccacaggtcatggggatggcttgccttgggatgagtgtgtagattgactttaaatttctaaggaggggagtttagatatgtattcccaaaacttaccatcgccatctggaagtttgaattaccatcttactgggaactgtccaggtgacctcacactagagctcatgtgatatccgtttatgatgaggtggttgtgtgctcagggtgcacacatatctctgagtgggtgtgaggcacatgccaggtgggcacagagacatccacctggaatcccagaatggtttgaacccctctacatatagacctttccttggtgctgggaagtcaattgtcctctccgacccttgagagggaaggtcctgggtggcccataatgtttcagatgttttaggtatcagtaacctttaaggacattactgtggatgccacccaggaacagtgggccctgtgaggcccagcccagaggtgccatgctggagaacaatggtcccctgggcctagtgggtgagtctgtcagcactgattgatttattcatttatctttaataatttcaacttttcttttcgattcagggggtccttgtgcaggtttgttacatgggcatatcatgtgatgctgaggtttggggtacgattgatattgtcactaaagcaacgagtgcacatggtacacaacggttagtttttcaacccttccccccttcttctcttccttccccctcttgaattccccagtgtctattgttcctatctttatgcccatgtgtactcaacatttacctcccacttgtaagtgagaacatgcagtatttggttttctgttcctgagttaattcacttaggataatggcctccagctgcatccatgttgctgcaaagcacgtgatctcgttctttttatgactgtatggtattccatggtgtatatgtacacattttccgtagccagttcaccattgaagggcagctaggttggttccctgtctttgttatcgtgaataacgatgatttattttttgaacatgtgtccacgacagcttggccacacccctcctctcagccctcagtcacactggttctttcacagcacaaaggactacctgaaggaagcttgttaatgtctctacatctggcttgtcacccaccagagcatcatcttcccattgcaatgtcatgcctttctggctgctagatctccaatacccagaacactgtggctatctttaaaaaataaatcactagattaaatttttaccaagcaacaactctgttctgagcacgaagctagcgtttgagagcatagcaggaaaaataactggcccttgcctttttcttgcaaaactgagattgtgctggtggagctttcattgattggattattatgaaaataaaggtcagccagctgtggaatcttccttcactctgctctgagcctggccatgcaaaccagcaacatgagctcccactgcctggagatccgaggcaggactccctcctgtcctgtgagggacactggtgtcctcagggtcagggtgctcttccctggctgcccttggaagcccacctcattcttcctcaggagcctgccctgaacctgaggcccatgcttggttctggcataggattcaaatccctgcagcttcactgcagagcaggagctctgccagagagaatttcccaggtggagcaaggacagggctgtggagggcagggaaggtcctccctggggcctgagtccaggtgagccgcagacaggtgtgctcctgggaggacctagccagggagggagcagggtcttagtgagcgcggtgcggagttccaggaatggtgttttcaggtagtatgggggctgctggttgaccggttcctttgaggtcatattcctcatgcgtatcagtctcccttcctatatgttcctgtcctcctgggcgtcggagtttcccgttgcagcctctgccctgacccttgcccttggaccgtttccctcccctttcatccctgaaatcccagatctattctatttttcctcttatatcaaccctgaaaatgttgtctgtccgtttcctaagtcgtgtttccactcgctggtgtacggattgtcaggttctaccccatgcagctgggtgggcctctccggctccttcctgctcctgtaggtttcatcccccacctcccccaacagcggcttttagctgcctggggccgcccgcctgaccctaggacgagtgcggaatgaccccctctccacgcggagccctgagcgggaggcggcaggggcccaggcagcaggaactgggaacaagccgcccggcaggaagtttcgggtggctggaatttaggaagaagctagcctgagctcaaaacctcctgctaaacaaaccttaaggcgcgcatccggctctgtttcccacctgcaggttccgcattccttagcccagcaggcggggaggcgggagcggggtcagaattggtggaaggctggggttgcggggtgcagagagtgctgagccatgaagacttggggcagcgaggccgagtgatggcagagcctggggaggcgtccaggctgcgggggagcagggactttggagcaatgaccctggggggacactgagcacagggccagggtggcgtccaggggtctcgggtaggcctggactaaagaggcctgggaagagagacgtggggaggtcaaagggccctggtgagtctggatgaggagcagaggattgagtccccccagaactgagtccaatgtttttggggggagggacaaggaaacagtgagggggtgggggccatgtgccactgttcgagggacaaacccagctcagaggaaataaggcacgggggtgaggtgacaagggacatgggggtgacagggccatgagatgaggggtgtcgaggtcgggccaggaaaagatcaactaaacagccgggggaagtggggacccagggaagcaagacatggaggcatgagggagaaaaagggaggagggggagctcagcaaatcagtcactgccaggcgcctctaggagtctgattttgtggcaccttagtcatgttttcagagaagaggttcatagtctagaggatcccatggccacatggccaacacagggaggaagtggggtgaagagctggggtgcccatctgtggccccgcttccttgtgaggttcccacaggccctgtgggcacacagcccagctctgccctgaactcagggcctgcctgggtcctgtctcttccctcctgtactttctgtctcagctgagctgttcttgcctgcaccttagcacctcaggctgagtgggagggagaatcctaaactggccctcaagattctgccccctggggaacagccctgtgtatagaatccctttcaccagggtggcctggatctctgaatactttgggatctcactccccaagttacatgactttacattgcagttagggggttttgaagatgtaattacaacccctaatcagtctactgtaagttcatcaaaaaggagattttcctggagaggcctggtctaatcaggtgatccctttcaaagaagggctggaggctgggcatggtggctcacgcctgtaatcctagcactttgagaggccaaagcaggaggttcacttgagcccaggatcacttgaccccatctctacaaaaaatacaaaaattagacgggagtggtggttgtatgcctatagtcccagctacatgggaggctgacgtgggagaatcacctgagctcagggaggttgaggctgcagtgagctgtgattgcaccactgcactccagcgtgggcaacagagcaagaccctgtctcaaaaaaaataacaggaagaagaataaaaaagtgggctggaggtcagaagcagaagggatcagcgtgatgcaaggcagacagtctcctgcaggccctgaagaggccacctcctgtgctgtgctgctgtgccaccgctatgctgctctgccaccttgtggagggcctccaggaaggtttctgaagctgctgcgtgtgtggcaattggttacgtagcagcagaaaacaaatgcagctttctactcctccctctcctaccccacccctggatctaaccagttcctgatattctctaaccaaggatcaccctgcacactcctggacagccctggtgtgaaccctcactcaccctgggtggctgaagatggtttgggataataatgataatagtggctcctgatatctgttgggcactaactactgtgcaagtattttatgcccatgaagccatcccattttcacaacaactgcataaggaggcatatctagaagaggatctagcagccttccagttcaacttcatttagacatcaggatcccaggcccagaggcacaggtcatggtttccaagccccatagggcgctgttttcaactgttaggataatccagaacacctggagggcgctcctatgtgctatgagcaaagcaaaaacatccttcattcaacagactctccccaggctgagcctgcagaccccctcttgtgatagggtcagaattcagtttttaaagagcttagtgtgtagatactattgatgatctttgggagctgaagtgttcttgaactccaggcatagtaacatgttttaggttcatttatttgaagcattatgaaaggaaaatatatgttacacctcaaaaggagtttagattctctgtagttataactactgtatagtcacatgactattttctaaattttaagctaaatattcagtgtgataagatactcatttttgtacatgttatatccacttaactattaaagctggtcatttattacctcacatgcagtgttaagataatgagtaaattgttcataaattttcactactattattgggaagcatcatggcatgtaataaatcatcttttttatacatagaatgaaatcaaggctagggaaggtacatactactccattcgtgctgtgtggctaagaatggatctcatcgattgtgtataatggcaagatgagtactaaaaatatttgtaggatcaatacttgaatgttcataagcaagatgtcacaaatatcccaccattcctacaaattaaaataattttagtataatttttagacagcacatttataaacatgtgccaaatagaacatagccacctagcacagtgactggattggatgtagtacgtctctggattcctcctatgtgtttactggagatgtttgggaagtcacctagtcctttgattgttcatattctttatccatgtattagaatttcatagtaactgcttagctgatgtgtttcatgtaagttacagaattgtctattaaacatgctgtgctcattacctattataggatattgatttttgtctgtatatttgcccttctttaaaacattctagtacttttactttttagaacatgcaggagaatacgtagcaggaggagagcaaagatgacaccaacttttttcatttcttagcccttttgatctatgttatggatgaagatatagatgaaaattaaggctgagatatctgatatcctgatatctgttgggcacttttaatctgttgagaattttaattgttagatattttacttctgattatgtgaacatatacaatttaatgattaaaatattataaatttcatgcttaataataaatgtctttcatatatgactccatcaaatctttaaactttgcatatttatactgtgaaaaaaaatgaattaactaagcctccggctttctaaaatggaagcaggagaagcactcaaatctgctaaaggtcaagccacagaatgttccagtagacttggataaacaactgaagccaatgtccaccagccttcagcatctttcagctgggagtggcctcgttaactgaccaatcaaaacgagtttacaacttcggatttctgcccaacaaatcaactgcctttaaaaataacttttgtggaaatccttgattcaaaaatgtttcctgcacttgccttacaagacactcttcagggccgccctgactcactgtacctgagttgcaattctttgtttctcaaataaatgctatttcctttgacctccatgcccatcttttttagtgaacagcacagtatcgtaactgttattggtatccattattaagactgttggacctttcattgcttcatagaattatctttatcttgggcaagaaagtgaaaattatccatagtttctttaaaatagtaatattttaagccactcaaaataagaaaaagttaaagttcacaataaaaagatcctgatttacctgaataagacttgaaaagtgaagaacaattccttctacctgaaaagggtgttgacccagaatccaccttggacgaccctctagagctggcaagtcagcgtcatccccagtgcacctgtgactgacaacacatctcacccagctgccatagggatgtcaaagacacaggatacagtgctggaaagggaaaaagcatcagtgcaaaagtagatttcaggatttggagcacggaggcaagtgccctctcctggcatccctgcatggggccatagtgaggaggctctgcagtcttccaggaggactggaccatggataggaaatacccaagacatggattctctagggacatgggcgattccaaaagcaccgaggagcgtgcccctagagaagcagtccactgggtccgtagtaaaatctcatggcataaccaatgtggagaccagagactaaaaatctgtaacgtccttggtgtccatggacctcaaagccaaacacaacagccccacgagtatctgtcatccaggcacggagagctaggggcgagcttctaagggtaaaggaggcttcttccctgtccagatgtgtggacgcttgggtttacagataatggaggtgtctatgtatgttgtcatgaaaatataaggcaagtggcaccaaatatgatttagtggtcccagaaattcggtgctgtgtgctttctgcacgacattaattttaattatatggacacagaaggagaaaatttaaaacttaaatgtcttatcattgctagaaaaataaaagttttttccctacgagttagaagtcttgatctctgcgtttttctatggatcgattctcaaagtttgtgcaaatacagttggtgtttctttctaagtgtctttggttatgaactaaggatgtaaccaactcctgcttattaggtaaagggatgaggcaagagagatccagcaacagggtgtgtttttttttcaatctttggcaacatttttctgtgatgtccaaagtagtgaactccctgactagggtttcagacatggagtgttctaatccaccaaacaccaaagggctgggaagaagtgatttggacatggataaccagtgtcacctacaacatggaacagagggtcatcaaagtggtctgagtcactttaatatgtggctggagagatgcaagaacaacagaaagagccctcaggaggcatccccacccaagggcagtgaagctcagtgcagctgcggggtgtggggtcatagggtgaccaggtgacagggctgatggggaggagaaatgctctgttaagggtgttgtctctgtcacttcttcaaaaagcagcacagtctcaggcacatgctccctcctgccccaccccacccacaattgatccactgcagctcttccaagatgcttccctccattctagtacctccccttactcctgagcccctgtggcctctatcttactccctctctccagttctttgtaccttcctcctctccctcactcacctcccctcccatgcaaagcccctactggttcccccctccccacttcacctccactcacactccatcttcaccctccattccagtccttcccttcctctcctcactctgactccaccggtgaactcacttcccatcccttctgtccatgtccctgcctcagtttacctcccttcccctctcctcaccttccttggatgcacctgacctctcctgcctccctccccttcattcatgcccttcctttcttctctctccagttccatctcctccaacatgctcccctccccctttccttcagcctctgttgacctctccaccctcccacagtcccctgcactctcctgccaaggacatccctcccagccatccccgccctcctcacctcacctcgtttggctccatgtccctcagctccccttccctccctcttccctgtcccaagagccatctgggtttcctttccagtctccctctgcttgtgtgctttcttccccttccctgacttcccctgctctatcttctcctcagttccccgccctccctctctgcacctgcccagtttcccccatctcccctccatgctccctttctcagtttccctccccagctcctgagttggaccacctcagctcagcgccctacttcctgtgcctgcccctgcctgctgcccaccctccctgcacacagctcacttctccctctggccctcctgctgagcaagtggctccccgactgccctgggcctgcccactttccccagcccccgcagtcaaggctctccacatcaccggggtgagggccgagatgcaccctctccagggctctgcttcctccagcaggtcccagatcctccctccaagctaagctccatggcccatccctcccctgggggcaacaccacagggaccttttgcccaccttgccaggcttttcagaggcctcgaagctgtggtcaggcaggcaagtggggagcaagccaggagttacagatccagagcttggggcagtccaggcagcgggggctgtggtcccctgtgaccacttctgtgaccttgccacttgaaccctccagggcctatgtcctcacctccaacgtgaagatcaggctgggccattattgcaaagctgtgctgagtgttgacaaaggtgcatgtcacgctttattacaggtagctggtgtttcctgagcatttggaaacaacgccctgtaaaatactgtgaactaatcgcagagctgggcacagcatgcttcatgatcttattttatactgacgtgttttgtcatcgtgctgtcaagtattctccagccacatcatttgttagtagtttgacctgcataggagggcagtgtcaccctccttcctgctgtgctgatttcagcgagggcctccgggccagactgccccgtgcgccccctgttgactaacctgggaatcgcccgccgcctgccttgagccttgtgatgtgggcaggacggggccggggcagggccaggagcctgcggggaggcgcggggccaggcgcctgcaggagtggaacctgcccaagatctaggagtagctcggtgcaggaccaggacagagttcacacccctggcttcacgtacacgtattttttttttttatactttaagttctagggtacatgtgcacaacgcgcaggtttgttacataggtatacatgtgccatgttggcttgttgcacccatcaacccgttatttacattaggtatttctcctaatgctatccctcccccagccccccatctccctgacaggccctggtgtgtgatgttccctaccctgtgtccaagtgttctcattgttcaattcccacttatgagtgagaacatgcagtgtttggttttctgtccttgtgatagtttccagcttcatccatgtccctgcaaaggacatgaattcatccttttttatggctgcatagtattccatggagtatatgtgccacattttcttaatccagtctatcattgatggacatttgggttggttccaagtcttttctattgtgaatagtgctgcaataaacatacagacctacacataaattaaccggtgtgtgtcaggtgtagataccagccaagaagaaaagacaaagtcagcgggggcagctctaggacagcgatgacctgggtcgcttcattctgtgcctggggaagaaccaaagccacttggagattaacgccatgacaaaaacaagggatgacgtgtgtgcagttgtgggtttcatgtttactttccacgactctagaggacttgcccacctgttcatacataaaccagtgcccagggccccactgcccggtgagggctccatctcccctatcaccccaccccctgcttagctcctggcccgccccaaccatcccttagttgatgagttggtgaagctgccccctttttcctccctataccttctcttctctcccccaggtcctgctgggccacagtcttcggtctctctgccccacctgccgaaggacccccctggtctcttgggtcctcacctgcatgctcccgagctcacctctaagttgtgtctgcccttcacaaggctggccccctgcagcccaccccctcacctggggcaccagggccatccacttcctccactctcctcacactcccgaagtgactcagggctcccctgagcagctgggctggagtcctcccaccaactccctcagttatacctgctcccgtcccctcagacccagccccccaggtctccagacccattcatggacgtggcctcctaggcctctcaacactcacctcccagcaacccctcagccctgccctccccaggcaccaacttgggacccccacagaggcagagacacctattcccacttgggctcatgtcaccctggctcactggggatgctgagcctgtgagcccaatcttgctccatccctccagttcctttctccaatccaagttctctcagacctgtggtgtcactcccagaagccatctggacacccaaggcactgcctgacggagatggccatgctcttccctgtagggatggacaagggacacctgcagtgcacaggtcacagtctcaacctttggaatggtgtggcaggctgtgccctagtagggcccccaccagggcccctgaatggctgctccccatcagtaacaaggaagacccttgatgatcatccccactgcctctgagatgggcccggaaaggcgtgagcttctcaagcacctgggtcaccatctgggaaatggcagtcatgatcaagtcaatcccttgtgccccagagacactgtaactccccagtagaatcccacagggattgaggccaccctaggcaacatagcaaggttccatctctacaaaaaataaaaacatagccaggagtggtggcacacacctgtagtcccagctattcgggaggctgaggcgggtggatcacttgaggccaggagttcgaggctgcagtgagtagtcattttgctactgcactccagcctgagtgacagaaggggaggagagggagaggggaagggagggaggagtgaggggagggagggagaggaggggagaggaggggagggagagagagaaggagaggagggaaggggagggcaggggagggagagagagaaggagaggaggggaggaagaagaggagaaagaaggaagaaggaagaagaagaattccagagagtgaagagccaccaagggtatccccacactctgtgcaagcgtctatctgcctgaaacatacatgtgtgaaactcactgttggcagcacaatcaagacggaaaattagacctgagagcagcctctgtggtctttgagagggacccaggggatgaccagaggcagggaggctccatgggagggagaaacacaagtagatggccttctctgtggcttccagcctggggcaaagggtggtcagtctcgagatgcccagtaggggaaaggctcgtgtgggaaaagggaaatcaaaaatcctgccacctgcacagcacaggggaatcacccaaggctccaaagggtcattactgtgatgtctgtagcataacatccacatcgctgtaacatccacaggggcctccttaacaccatcaggctctggaatcggagagcagaagcttcacagctgtagctgaagtgggtctgagtacagactaatctctatcgtgcagcttactattatccctcctttagggacatggtcattttaaaatattttattttgaaataattatagaacttatagaaaactgcaatagcagcataatgggtgcctgctcccttcacccagctcccccagggcttctagttttgccatgtgtccccacctcgctgaccagccccagtagacggcaccaaaggcaggcaggatcacacactcctctttgctcaaaacactcagggatccttcctgccccacacaccctctccatgcacccacattctctgcccaagggtggcctggcccccaggcccagctcatccccagcatgtgactcctttcactcaggctgtggatctcatgtattgcaaatgtggtttaaactttgagaacagcaattctggtttgtagaaaaaaagtgaggatctaggcgtttgcagtcatgcacatgttcgtattttaaatacaggccaatgagctgctgcctagtgtgcctaccagagacacacctgttgttaaactacaactggatttactgttccattctgcaaaaatacgccatggtgctgtggagggtgcagtgagaggcttggaagagccttgccacaggctgtgtgtgtgtgccagctggccatgggtggactaactggagaggggctggctctgagttgagcactgttaggaagcaggaggaggtaggtatacactggaatcttcataaacctcatccccggggaggcctgacacgggcaggacaggctatcaccaaggccaaagcggcagtcatcatgtgggctgggagaggacacggctggcactcctggcctgagagatgctcccatctgtctgtattcagacaggattctggagtggcttgtctttgtcttgatcagaccatctggggtcttgcctgctgctggtgtcctgagggacagtttgtgttctccaggagagccccacaacctcactgagggtgccagcccagctcctgggacacagccaccctcctccttctcaagctttaatgagaaacgggcaggaggttgccggagaaccactgcccatcttccggggtgctaggggtgtctgctggcagttgtggtctagggcaaaaagagaagggaagggaaaatctttcagaaaataacggaatcacaatggggctgcaggcgagatgagcaaactgggctggtggcatccagggcgttagcaaagaaaaaagcaccagtgttcaggcagccagggagcccagccgctctcttagggtcaccccctcccagccctccggaggccacccttgtcccgccctgccccaagggcacagcccgcgcccctcccccagtcctctccctgctgggctgccccctcccgcggccgcatccctagtcagtccctgagaccgtccagagttcagtccccgggatcaggcttgcagtgttgggccgccctccttgccagatgccgccctggagagggcaagggcgcagaaagggctgagcgtcccgggtccctgcgtggccgaacggcatgtgagcacattccaggaataaggaaacgagaggagtaggcatttctaccgtctaaggcactttgcatgaaatcccgtggcactggaaaagtagttcaaacaaagtaacgctggcttttacgatgcagataaacggataagcggcgtaggactcaagtaggagggctccgtgcacaccaggcgcagcccagcggggatttgcctgcgcgtcccagcgcacagggaggtcgctgagtcccagggaagccccctgggctcgcgctgcaaactcaggcagcctctgctcctgccctacggctttgagggcacgtgctcctccggggaggcacagcttcctctaatttcccacttcctcatccggcccttaattcactaaagactaacagggaatgatgttcattaccaaagtaggtgctccccctagtgtagcacagaacgcggcgctgttctcactattgaattggaataatatttttagtatcaaaattaattctagaaatctattacagttcattttccagaaaacaagggtagcaaaaatagtataggtttgtttcttaatttctttatgacacacatcactggttcatgtgataacgtgtggattctcacctggaagacacaagaggaataaaatcaccatattttaaactctatctcaagtctctcaacatttcaggctgtgctcatttacacactacagaatgatgagtattcagtggaaacttttgcagaacaattaaaattgcaaaatcggagccgggcgcggtggctcacgcctgtattcccagcagcactttgggaggccgaggtgggagtatcgcttgagcccgggaattcaagaccagcctgggcaatatagtgagccatcatctctaaaaaaaaaaaaaagaaaaagaaaaaattgcaaaattacctaaaatgaaatgcatacattgaaacgcccacaattattatgaaaattaaagttaatattaacaacatatgacatgagccacaagatttacattaaaatagtctagttgacaataacttgaatatttaaataaagtcctctttatctctaaataatatatttacagtctgccattatatgaatcacttaaaattcagatgaggatattaatcaatattgacaatttcttcaggaatatcaagtgaataataatgatttcacttttttgtttcattttgtttttgacataagatcttgttctgctgcccaggctggagtacagcagcaggatcgtgactcactacagcctctgccttctgggctaaagcagtcctcctacttcagcctcctgtgtaactgggaccacagatgcacaccaccaggcccaggtaattttttattttttggtagagacagagtcttattatgtttcccaagctagtcttgaacttctgggctcaagcaagcctctcacttcagccacccaaaatgctgggatgacaggcatgagtcaccatgcccagcataaagattttattatgtggaaataaaaggacattaaaatataacttgaaataacccatttctcgcaagtatttatttttccaccagttaatcaaatagtgccaacactagacaccaaccccacttccattgctaatcccactaatacactcaccaagacttcaattcctgacccccatgtctcaggatactcctcaatagccattgccatagtatatccaaaaacaaccatcgtaccccctagataaattaaaaaaaaccattaaacccatataacctcccccataattcagaataataacacacccaactacaccactaataatcaatactatacccccataaataggagaaggtttagaagaaaaccctacaaaccctattactaaagccacacttaatgataataaagcatatgtgattaatcccacatggattacaaccacgaccaatgatatgagaaaccatcattttatttcgactataagaacaccaatgaccccaacatgtaaaactaatccactagtaaaaataatcaaccactcacttatcgatctccccgccccatccaacatctccatatgatggaacttcagcttgcttcttggtgcctgcttaacccttcaaattattacaggactattcctagctatacgctactcaccagacgcctcaaccgccttctcctcagtcgtccacatcactcgagatgtaaactatggctgaatcatccgctacctccatgccaatggcgcctcaatatttttcatctgcctcttcctacatattggccgaggcctgtactatggcttatttctctacctagaaacctgaaacattggcatcattctcctactcacaaccatagcaacagccttcataggctaggtactcccatgaggccagatatccttgaggggccacggtaatcacaaatctactgtccgccattccttatgtcggaacagacctggtgcagtgggtttgaggtggttattcagtagacacacccactctcacacgattcttcaccttccactttatcctacctttcattattacagccctagtagtcttacacctactatttctccatgagacagcatcaaataacccctcaggaatctcctcccactccaacaaaattaccttccacccctactacatgaccaaagatatcctaggcctatttctcctccttctcaccctaataacactagtactgttttcacccgacctcctaactgatccagataactacaccctagccaaccgcctgaatactccaccccatattaaacccgaatggtattttctatctgcctacgcaatcttatgatccatccccaacaaactaggaggcgtactggccctcctactatcaatcctcatcctagcagcaattcccacacttcacatgtccaaacaacaaagcataatattctgtccactaaaccaattcctatattgactcctaattacagatctccttatcctcacatgggttggaggacaaccagcaagctaccccttcatcaccttcggacaaacagcattcgtagtttactttgctacaattctagccctgataccgcttgcctccctactcgaaaacaaaatactcaaatggacctgcccttgtagtataaaccaatatattggtcttgtaaaccagaaatggagactctctcccaaggacaactcagagaaaaagtacttgacttcaccatcagcacccaaagctaagattctaatttaaactactctctgtattctcatgagggagccattttgggtacaacccaagtatcgacccaccccaccataattttatatatatcgtgaatttctgctagccaccatgaatattatatagtactataattgcttaactgtacatagtacatatcaaacgaaactcaacaacaactcctccccacgacgcttacaagcaaggactagaataccttaactaacggtaacacattaaacccaccctccaaaagaaacttctcaaccacaagcgtaccaaaaaacactatatatccttgagtacatagtacatctaatcgctcatggtagatagcacattccagttaaacaagtcctcgtcaatacggatatccccctcagatagtggtccgttgttcaccatcctctgtgaaatcaatatcctgcagaagagtgctactcttcttgatccaggtccataatacttgggggtagctataatgaactgtatccggcatcttgttcttacctcacagccataaagtcaagaccaaccacacgttccccttaaataagacatcacgatggatcacgggtctattaccctattaatcagtcacgggagctctccatgcatttggtattttaatctggggggtgtgcacgcgatagcattgtgaaacgctggccccagagcaccctatgtcgcagtgtctgtctttgattcctgccccatcccattattgatcacacctacattcaatatcccaggcgagcatacctatcacaaggtgttaattaattaatgcttgtaggacataacaatcagtaaacacacccacggccgcttttcacatcaactctacaataaaattctgcaaatccccttcccccatctttggcctcaccaacccaggaaaagacatctttgccaaaccccaaaaacaaaaagccttaatccaactcaaccagagcccaaatttttatctttaggctgtacgcatttttaacagtcacccctcaactaacacgtctttttccctcttagcctcacttcacagactctacaaatttagttatccctttttcagccatcccattcaacgcatgcccgaccactactaaaccaacaccctaaactaacccaaccccaaaggcaaggctttcccccctacccattgcttgtatgcccatcccctagccttgcttacactgtgcaatcacagtctatgtagcttaatgacccaaagcaagacactgaaaatatctagatgggcctacactgccccatagacaaataggtttggtcctagcctttctattaactcttagtaagattacacaagcaagcatcgccaccctggtgaaataaccctctaaatcactacaatcaaaaggagtaagtatcaagcacgcattagtgcagctcaaaacactttgcctagccacacccccacgggagacagcagtgataaacctttagcaataaacgaaagtttaactgagctatactaactttagggttggttaatttcatgccagccaccacggtcatacgatgaacccaagctaatagagactggcgtaaagaatgttttacattatccctcaataaagctaaatttcacctaagttgtagaaaaccctagttgatataaaacaaactacgaaagtggctttaatatttctgaatacacaatagcgaagattcaaactgggattagataccccactatgctcagccctaaacttcaacagttaaatcaacaaaactgctcgccagaacactaggagcaacagcttaaaactcaaaggacctggcggtgcttcacatccctctagaggagcctgttctataatcgataaaccccaattcacctcaccacctcttgctcaacccatataccgccatcttcagcaaaccctgacaaaggccacaaagtaagcacaagtatctacataaaaatgttaggtcaaggtgtagcctatgaggtggcaagaaatgggctacattttctaccccagaaaattctacaataacccttatgaaacctgagggtccaaggaggatttagtagtaaattaagaacagagtgcttaattgaatagggccataaagcacgcacacaccacccatcaccctcctcaagtatatttcaaggactatctaactaaaacccctatgcatttatatagaggagataagttggataaaccaaggtgtagcttaacataaagcaccctgcttacacctgggagatttcaatttaatttgaccaccctgagctaattctagccccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaagatggcagaccccagcaattgcataaaatttaaaactttacaaccagaggttcaacccctcttcttaacaacatgtccataactaaccttctacttcttattgtacctatcctaatcgccatggcattcctcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaaacttaagaaatatgtctgacaaaagagtgactttgatagagtaaataatagaggtttgaatcctcttatttctaggaccataggaattgaacctatccctgagaatccaaaattctccgtgccacgtgtcacaccctatcctggagtaaggtcagctaaataagctatcaggcccatacccagaaaatgttggttatatccttcccgtactaatcaatccactggcccaacctgtcatctactccaccgttttcacaggtacactcattgcaacattaagcttgcactgattttttacctggacaggattgaaaataaacatactagcttttatcccaattttaattaaaaaaataaacccccgctctacagaaactgctatcaaatactttctcacataagcaaccacatctataatcctcataatagctatcctctccaacaatgtactctccggacaatgaaccacaaccaacaccaccaacaaatactcatcattaataatcacaacagccctagtaataaaactaggaatagcccctttccgtttctgagtcccagaagtcactcaaggaacccctctaatatccagcctacttcccctcacatgacaaaaattagcccctatttcaattatatatcaaatctccccattaataaacattctccttaccctttcaatcttatccattatagtgggtagctggggtggactgaaccaaacccaactatgtaaaatcctagcatactcctcaatcacccatataggctgaataatagcagtactagcatacaacccaagtatcaccattttcaacctaatcatctatatcattctaacaaccaccacattcctggtactcaacttgaactctagcactacaaccctactactgtgccgcacttgaaataaactaacctgactaatacccctaatcccatctaccctactatcactaggaggccttcccccactaactggctttctacccaaatgatttatcattgaagaattcacaaaaaataacaacctcattatccccactaccatagccattattactctctttaacctatatttttacatacgcttaatctactctgcttcaattacactattccccatatccaacaacgtaaaaataaaatgacaatttgaaaatacaaaatccacaccactcttccccacactcactgtccttaccaccctcctcctaccaatctctccacttacactacccacctcatataaatttatgttaaacgcagactaagagccttcaaagcccttagtaagttaataatacttaatttctgcagcacccaaggactgcaaaaccctactttgcatctactgaacgcaaatcagccactttaattaagctaagcccttgctagatcaatgggacttaaacccacaaaaatttggttaacagctaaataccttaatcaactggcttcaatctacttctcccgccgcaagggaaaaaaggcgggagaagcccaggcaggattgaagctgcttctttgaatttgcaattcaacatgaaaggcacctcagggctggtaaaaagagagtttttagatttacagtctaatgctttgctcagccatcttacccactaatgttcgccaaccgctgactattctcaacaaatcataaagatatcggaacactatatttattgtttggtgcatgagctggagtcttgggcacagccttaagcctccttattcagactgaactaggtcaacctggcaaccttctaggtaacgaccacatctacaacgtcatcgtcacagcccacacattcttcataatctttttcatagtaatgtctatcataattggaggttttggcaattgactggtccccctgataattggcgcccctgacatggcatttccctgcgtaaataacataagcttctggctccttccccacccctttctactactgctggcatctgctatgatagaagctggtgccggaacaggttgaacggtttaccctcctttggcaggaaactattcccatccagaggcctctgtagacctaaccattttctcccttcatctagcaggtgtctcctctattctaggagctattaatttcatcaccacaattattaacataaaaccccctgccatatatcaataccaaacgcccctctttgtctgatctgtcctaatcacggcagtcctactcctcctctcccttccagtcttggccgctggcattactatactgctaacagaccgtaaccttaatattacctttttgacctggccggaggaggggaccctatcctataacaacacctattttgattctttggtcaccctgaagtctatattctcatcctaccaggctttggaataatttctcacatcgtaccatattattccggaaagaaagaaccattcgggtacataggtatggtctgggctataatatcaattggcttcctagggtttattgtatgagcccatcatatattcacagtagggatagatgtagacacacgagtttactttacctctgtcactataattattgccatccccactggcgtcaaagtatttagctgacttgctacgctccatgggggtaacaccaaatggtccaccgcagtactctgagccctaggattcatcttcctttttacagtgggtggcctaacggacattgtactagcaaactcatcattagacatcgtactacatgatacatattatgttgtggcccactttcactacgttctatcaataggagctgtgttcaccatcatggggggcttcatccactgatttcccttattctcaggctacacactcggccaagcttatgccaaaattcactttgccatcatatttgtaggcgtaaatctaaccttcttcccgcagcactttctcggcctatctgagatgtcccgatgttattccgactaccccgatgcatataccacaggaaatattttatcatctgtaggctcattcatctccctaaaagcagtagtgctaataattttcataacctgagagaccttcgcttcaaagcgaaaagtcctaataaatgagcaaccttccactaacctagagtggctgtagggatgccctccaccctaccatacatttaaagaaccagtctacataaaacctagacaaaaaaggaaggaattgaacctcctaaggctggtttcaagccagcctcataacccctatgactttttcaacaagatattaggaaaactatttcataacttcgtcaaagttaagttacaggttaaaccccgtatatcttaatggcacacgcagcccagctaggtcttcaagacgccacatcccctatcatagaagagctaatcgccttccatgatcacgccctcataatcatctttcttatcagctttctagttttatacgccctcttcctaacaattacaacaaaactaacactaacatcacagacgcccaagaaatagaaactgtttgaatgattctacctgccattatcctagtcctaattgcccttccatccctacgtatcctgtacgtaacagatgaaatcaatgacccttcttttaccattaaatcaatcggacaccaatgatactgaacctatgaatacaccaattatggaggattaattttcaactcttatatacttccaccactattcttagacccaagtgaccttcgacttcttaaagttgataatcgagtagtccttccaattgaagcccctgttcatataataattacatcacaagacgtcctacactcatgaactgtccccacattaggcttaaaaacagatgtaatccccggacgcctaaaccaaaccacattcaccgccatacgaccaggagtatactacggtcaatgctcagaaatctgcggagctgaccatagcttcataaccatcattctagaactaatcccgctaaaaatctttgcaataggacctgtatccactttataggctaccgcccactctcttaataaggttcactgtagagctgacccagcattaaccttttaagttaaagactaagagaatcgctatctctttacagtgacatgcctcaactagacaccaccatatgacccactatcgtcgcatcaatactcctcacattattactcatcattcaactaaaagtactaaacacaaactaccatctgcctacctcactaaaaattattaacatgcaaaaccacaataatcctttagagtcaaaatgaacgaaaatctgtttacttcattcattgcccccacaattctaggccttccagctgcagtgccaatcgttctatttctccccatgctgattccagcttccaaacaccttatcaacaaccgattaattaccactcaacagtgactaattcaactcaccctaaaacaaataataacaataaataacattaaaggacgaacctgatccctcatgctaatatccctaattatcttcattgctacaaccaatctcctcgggctcttgccccactcattcacaccaactacccaactgtcataaacctggccatggcaatccccctatgagcaggtgcagtaattacaggcttccgctttaaaaccaaaaataccttagcccatctcttgccacaaggcacaccctcacccctcattcccatactaattattatccaaaccatcagcctatttatccaaccaatagccctagccatgcccctaactgctaatattatggcaggccatctgctcatacacttaatcagaagcgccacactagcgctatcaactatcaacctccccacaacctcaatcatcttcacaattttgattttactgacgattctcgaaatcgctgtcgccctgattctagcctatgttttcacactcctagtgagcctctacctacatgacaatacataatggctcaccaatcacatgcctatcacatagtaaaacccagcccatgacctctaacaggggccctttcagccctcctaatgacatccggcctagctatatgattccacttttactctaccaccctactaacactaggcctactgaccaatgcactaaccatataccagtgatgatgtgatgttgtacgagaaggtacataccaagaccaccacacagtacccgtccaaaaagtccttcggtatggaataattttattcatcatctcagaagtctttttcttcgctggattcttctgagcattctaccactccagcctagcccccacccctcaactaggaggacactgacccccaacaggcatcactccactcaaccccctagaagtcccactcctaaacacatctgtactactcgcatcgggagtttcaattacttgagctcaccatagcctaatagagaacaattgtaatcaagcaattcaagcactacttatcacaatcttactaggcatctacttcaccctcctacaagtttcagaatactttgaagccccctttactatcgccgatggtatgtatggttcaacatgttttgtagctacgggcttccacgggctccccgtcatcattggttcaacattccttactgtttgccttatccgccaactattatatcattttacatccaagtaccacttcggcttcgaagccgctgcttgatactgacactttgtagatgtagtttgactattcctatatgtctctatctactggtgaggatcttactcttttagtatagacagtaccactgacttccaattaactagtttcgataacactcgaaaaagagtaataaacctggcactagccctaacagtcaacaccctcctggccccattactaataaccatcacattttgattaccacaacttaatatctacataggaaagtctaacccttatgaatggggtttgacccactatcctctgctcgcattcccttctccataaaattcttcttgattgctatcacctttttattatctgacctagaaattgccctattactacccctaccgtgagccctccaaacaaccaatctaccactaacagttgtatcatcactcacattagttactatcttaatcctaagtttgacttatgaactatcccagaaaaggttagactgagtcaaattggtaagtagtttaacagacaaaaacaatgattttgacttgttagattatgatagtcatacttacaaaatgcccctcatctacataaacattacattagcatttactacctcactgttaggaatactaatctatcgctcacacctaacgtcctccctactatgcctagaggggataatattatctctattcatcgtaaacaccctcataaccctaaacacacactctcccttaattaacatcatacctatcaccatattagtctttgctgcctgtgaagcagcagtgggcctcaccctactagtctcaatttctaacagatacggtctagattatgtacataacttaaacttactccaatgttaaaattaattatccctacaatcatactacttccaacaacatgactctctaaaaaccatataatttgaattaacataaccactcacagcctaattaacagctctatcccactgttatttttcaaccaagccaacgacaatctatttagctactctctttctcctctgaccccctgatgacaccccttctaatactaacagcctgacttctacctcttatgatcatagcgagtcaatgccacttatctaacaagtgccccttacggaaaaaaactttacctgtctgtactaatcacccttcaaatctccctgatcataacattcatggccacagaactaatcatattgattattagtggtgtagttgggtgtgttattattctgaattatgggggaggttatatgggtttaatagttttttaaatttatctaggagtatgatggttgtttttggatatactacagcaatggctattgaggagtatcctgagacacgggggtcaggaattgaagtcttggtgagtgtattagcgggattatcaatggaagtggggttggtcttatgagtgaaggagtatgatggggtggtggtagtggtcacattctttgctgaacaaacggtacctcaaataacttcatacaaatactactgggaaacttagcattttattaaaatgtttaaatttcctattttatcaaatctaacatattagtaataatatattccttttattcaactttaaagttctattcaacaatagcaatttataattttatattattaaatgttattcatacagtttaataattttataatttagcattaatgaaaccagcacagacaatataatgttcatgatattttatgtatatgtttaacatacacatacataattcaacattaatggcttccttaattaccattaatattataattttatattatcatttaagtttgcccttctattttaatattagatgtcttagcatccatcagttctatcaagctcttctcactggttcttctttgaattccagacatggccacaatcttctcttctaaaattctaaaatctgagggctctcgctggctgggtgctgctggaagaactgtaacttggttgttatctcaacggtattttattttaaatgtttcaattaaaagaagtttttaaaaatgtggaaatccctgagaatattcacttttttaaatacaatgggaatgtatttaatgtatggctgaagtctgtttctcctcgtttgatccaggggtgcttctgagaactcttccaagtgccagatcctgggccgctggcagcttggccccagtggcagttcagttaccccatcacggctggggcaccaggggagccccacaggtgggcgaaaattaccgtagattaaaacctaggcagtttaacacaagcagccagcaccaacatcacggtacttgatcttccaacttcctgcactaccaattctatgtctcatcacattctcctctggcctctcggcccccagcacacaggcttcagcctctgtttctgctgaagccctttcttcatacactctagaacatagaacataggacagagagagagactttagtaggaatactgacatttaaaaacttatcagagatatgaaaaatcaactacatgaagtacggcggtatattaaggctttgtgaataaaaacacagtaaagggtgggtgtgtaaagctattttccaaccatccttccaaaccaaggcttttgagggcacaagtcctcccagcaggtggcaggatgggcccagcagtgtcttcagcccattgctgtcatgagttaggaaaggctgaattctattttacatacaaaagaaaacatttatttaattaaagattcaagctacaatacagttcttcataaaacactacaatattttgattatcaatgtttttctgttgctttttctcatgaaacatgatttgcctttgtgaaatctgaagtttcctattctatcaatgagaaggtgtatcaaatggatagtccatccagtgtatccgacatcaattacaaaatgcctccctttttcttaattttgccttttttccctttgtcattcttgagtctctgttagtgcactgaggaagtgaagacatgtacttaaagaaatgccaacatctgctgaagatcagattccgtattttgtattttagttgatgtaatgatgactttagttataatgactttagttgatgtaatgattctaatgaacaagaaagattttgtttcccattttaaaagatatcattaagtcatgcagaatatttttcaatttattatgggtgtgtatgcaaggggttgccatttcacctgcttcagtcttccctctaaaccaatcctaagacacacctaggctgaattcatatcacatgaaaattcatcacatgatgtcctactaggtcaaaaagtataaaaactgacattacggagaaagacttcattgaaaccaggacagaaagacactaaggcacacagtgctcagagcggcatgctgacaagatctctggtgggaggccattgcctggacacctgctgggttttgtcctggacaccattcattcacttgagcatgtttggtacccagggtatttttcaataataggcaaaatagaatgagttcttcaaaccttgtggattttatactgaaaacttccagagatatatcttaggtaattataagaccaagcacaacaacaacaacaaaatcctaacttgaatccatcagttgcagatttcatggttgactacatcaagaggaagttgcaagctctaaaagctggaagaccagtcaatatcaggaactcctcagaagtgaaggaaaagtggtttaaatttgtttaacaaaaccatgttttcaaacttactttaatttatgcatgagggccattaaatttgttctttttaaaaaggaaacttcttaattggaactaaatcattcattattcactgtgatacgggttatatacccttaggttccatgtgattattcacatgttcagctgacagaaaggagaaaaagctactctaatgacttagcttcgctttgactcactggtttttatctcattttaacttccaatctcggttacagagagtgttaaagctggaagaaataacattttggtagatggtaaaggataagtacgagtcatttcaagttgttgaagctttcattaaacaaagcaagctatttgaaatcttaaagctatttaaataaagggctaagacttttccgttttatttacttaaaagcttaaaagatactgttgaaaatttaacagttaatctattgtagggtgtggttagacacttattttgacagtgctcactgaaaattcaattatacccccggagtcaaacttgccagtcatcaaaatgtctaacgatctgagtgttcacggggtaataacaaaccccatactaaacagtttgctagaaatctgtcctataacatctaaacggaacaattgggtggttgtctaagacacctaagctcaatatgacatttcagctaaaaagagtgaacttataactaagcacttcatgcaagttaccaaaagagaagatattctttaataaaaaagtacatttgtagaatcaaagaatctcagtgttgtaagaaatatttgagatcatttcagttaggcttttcatttcttaaatttgaaactgaagctgagattaaacagctaataaaaagacaaagccgatccatgatattggtttgggcaatgatttcttagatatgaccaaaacgcacatacaacaaatgagattacatcaaactaaagagcttctatacagcaaagaaaacaattaacagagtgaagagtgacaactcacagactgagaaaaaatatttgcaaatcatatgtttgataaagagctaatacacaaaacatacaacgaattcaactcaataacaataaaacaaccttgttaaaaaatgggcaaaagacctggacagatatttctccaaagaagacatacaaatggccagaagagatattaaaaggtgttcaatatcaccattgattagggaaatgcaaattaaaatgagatttcaccttactcattttagaatggctattacaaaaaaaatgaaagacaagtgttggtgaggatttgaagaaaagagaacacttgtaaaatgttggtgggaatgtaaattagtgctgccactatggaaaacagaagggacgtttctcaaaaataaaaatacataattactatatgacccagaaattctacttctgggtgtatattcaaacgagttaaaatcagtatgttgactagatatcaacacttccatgttcattgcagcattattcacaatagccaagatatggaagcaatctaagcgcatatcaagggatgaatggataaagaaaattatatacacatatttatagtgtatacacacaatggaatactattcagcctttaaaaaggatacaattctgtcatttgtgaaaacaaagaaaaatctagaggatcttacataaagtgaaatcagtcaggtacagaaagacaaatacatcatgatctcacttacatgtgaaaagtaaaaaatgtcagactcatagaagtaaagagtagaatgatggttaccagaggctggaggaggcaggatagacagaaaaaagaagattaatttgttaaatggtacaaggttcagctagatagaagaaataagtcctagtgatctattgagcaatagggtaattatagttaataataatgtattatatatttcaaaattgtggagtatattttaagcactctcaccataaagtagtgataaatacgtgagttgaaagatatgttaattcacctgatgtaaatgttccacaatgtatacatgtatctaatcatcatattgtatgccataaatacatacaatacttaattatcaaataaaaagttaagatggagctgagccaagaatccaagtctctgaatttagatttttcattttctattatgccaaagtgttttctgaaaattaaaattgaatatggcatgtccaaaagaatatgtcataagaagacaggaatggggggactgctgcatataatctcatatttttagtcagttttgtaacatattattaggagaagaaaatcaaatattttaagaaaatttttataactcctgtaatactgtaattttatggcaaacctaaaaccttcaaaacacagagtttttttaaaaaagtgaatcatatatatgcaaagtttttattgagattattaaagcaaaatccctcaaagtagcaaaacataagtatatgttttagactgtactatgcagaatagcagaatggtaccaatggcaaaaaatctttcaaaagacataaaaattattgaggtctcatcccagctctactaatctatgtcttagcaacctagtgtaattcctacaagttctgaacactgcctttaatgtatctgcatggttcccatatcattttataaacttcaaatattcacactttataattgaaacaatatacaaactttattattaaataagctatgggatgatattctccatctaccctataaggatactatcttcctgtcagaaaatctgagactctccaatacatatttactccccagatcttttctttttcttttttttttttttttttgagacggagtctctctctgtcgcccaggctggagtgcagtggcacaatcttggctcactgcaagcactccccatatcttaactgtggaatctccagaccatgtccagtcagtaatccattattagttttgtctcatgtgccctaaccaccttctctttaccttctatttcagccccaaataaaagttactattcttggctcaattctccaaatcctttgaaggtaactggtgacactatagcttttctttatgtgccaccttgtgatccaggcttcctagttatctgtgaatattcacatcaggttacctggactccatagaggcagcaccaacaaaaaacataattgggatatacaccacttttagactttcgattacatgccccaccttataatgtgtgaactgatttcacttctagacattcaactttcaaacaggtatgctctgtattaaacaccaacatcctccttccctttcactcaagggacatcgggaaaacaaaaagatgcaatgcaaagttcacatataaggataattatttgtgataatggtgacaatgatccctatttcttttcctgctcttatgaatttgcaaatgtcctacaaactgtattaaatgagtctgtgaaagttcatctaagtccctagtattattattttttaactctctagaaagtcctagccacgtagctcaaagcaaaatagaaaagatccaaatcattcataggacaagtgttgaggcaactttcaattactaaatatatttttagccatttaaaactaaaagaaaagtaacgtctgtaatcccagcactttgggatgctgaggcaggcggaacacaaggtcaggcgatcgagaccatcctggctaacacggtgaaaccccgtctctactaaaaatacaaaaaattagccaggcctggtggccggcgcctgtagtcccagctacccaggaggctgaggcaggagaatggcttgaacccgagaggcggagcttgcagtgagccgagatcacgtcactgcactctagcctgggcagcagagcgaaactccgtctcaaaaaaaaaaaaaaaaaaaagtaagaaaactcttttactcctttttatgatttaaattttattttaggtttgaaaagtgagctatatatcacttaacagtcaggaagcgtgcagtaaactcaatctctgaaccgacgttacctaaatcaaagatgttcgttttctcatactcatctctaaaacagaggtagacagagaaagtgcttctttttccgagattgtaatgaattcaaacctattcattaactttatagcagttattttggtttcacagtgaaacataaaaagttctattttattggaaagaaaaccaagtagctatctaagtagttcatgagaaggaatttgttctactgttttaagtgcatgagggataaagcaagacttagaaatatttttgttagaccatttcattttaatagtattttctattataacagaaatgacctacagtaaaataattcaaaatacccttacttctgaaggttatttccacataaaattgtaacattactatgatctaaatttaaataaattttctattgatgttaaaagtttgataatatacagtttgttaaagtggtttggtcactatttgggcacgatcgacttcaaaccataggtgtttaaatgaaccaaagtcttttgtttatttctatagctttttgcctagtttgattaataactagtataccagtcattcacatatagtcataactggccaaccaaggtttacttggtaggagggtgacagtttaccctttaataccacctgattaaaatacacaagatgttctacacaaataacaacaaattgtttatttctaagaacataattttccttttataggaagctctcaactttaatttggagtcacattttaattttataatgtaataattcaataaatggtcattagatattgggttatttggaaaactgcaaaaaatcaaacttctgacaatgtcctttaaaataattaactcagctggaaatagttaaacaagacttaaaaatacaaatcataatggccaggcatggtggctcacgcctgtaatcccagcactttgggaggctgaggcgggcggatcacgaggtcaggagatcgagaccacggtgaaaccccgtctctattaaaaatacaaaaaaacttagctgggagcagtagcgggtgcctgtagtcccagctacttgggaggctgaggacagagaatggcttgaatccgggaggcggaacttacagtgagccgagatcgcgccactgcactccagcctggggcaacagagcaagactccatctcaaaaaaaaaaaaaaaaaaaagaaaatacaaatcataacgtgaatattcaaatgattgtacagtgtaacaattgtatgcaaataattaagaatagtgactataataaaaaagtttaatagatttgacatcaacatttaaagaatataacttacatatacgaaaataagccatcaaaacttgaagctgtcaaattgtgaaaaacagtagtaaacaataaaaatcactgactcattggaaacactgcaaaatgtcatgaaaacatttcagaaatgaaggtacgttaatgaaaaataatcatagttttaaattcagtctcacctcacctttaagaaacagtgtaaaacagcaataaatgggataatttatattactgcaataaaatgcaaatatatatatattgtgtactagcaccctctcttcaatgtatactttaacccaatagctttctaccactggaaatttatcataagaaaataatggtggcttacacctataataccagcactctggtaggctgaggcagtaacgtcagttgagcctaggagttccagatcagcctgggcaaaatagtgggattctgtctctaccaaaaaaaaaaaaaaatgccagtcatagtggctggcacctgaatccttgctgcttgggagactcatatggacctaggctgatttgagcaggggtatcatttgagcacaggaggtcaagtctgcagtgagctatgatcattccatcgctgcagcctgggtgacagagcaagaccctgtcacacacgcaaaagaaaataattcagaatgcgcccaaaaatatataaatatatttctgaaagctgcatttgtaatactgcaaaatcaatgccacattgagacaggggtaccaagattaaggtagagtcaccaatgacaattaaaatctggagtcagaatgctgtatctaagtaggacaacaatttctctgctgcagcctaccattaccatgcagcaaagttgctctattacttctgaattttccacattcttaaagaaaagcagaaaatccagtttctaagacaaaaatcaagttataagtattgacagaaaaatcacttttaaataattgtaaaagtaacaacacactataacagtaaatctaattcagcctgataccaggctgtaccaatagatataatgaaactgcataatattggtaaaacaattgtatggtagaaaaatactggcataaaaatgttcatagcaaattcataaatggaaaaagtagtctgttttatttaaataaaaaggagctaaatgaatggcagacaactacaaattaatagtttatacctttcaagtttagaattaaggatatatttttctttattttttgttttcattattgtgatgtattatgctgaaattagcaaaaaaaaaaaaaaaaaaaaaaaaaaagagagtatctgaccaatacagaaatttgtattgagaagtaaggtgtgtccctaacaaacccacctatgagtcagtttgaaggtagcaagaaaatttttatcactgtcatatacttcagaagtatttgtgtacctaatgatttccagtgtcatcaaacataggtaagaacactgagtattagcactggttgatatttggtctctacaatagtgagtatggtggttaattttagatgtcaacttgaatggactaagggttgcctagagagctagtaaaacctattaaagtattatttaatatagtattgtagaatatacgttaaatacattatgttacatgtattctaatgcaacacattataatatattaaagacattattccattaatacagtacttagtatagtattacttaatacattaaaatggtaactaagcttgacgaatccctgagcaaagccagttagacctcataagcagcctctcaaccttgcttgttttgcaaacattaacaaaacttcaggtattttttgtaaatgcctatatgaaagaaaaacagaactttctttttctttccaaataggagtgtttactatagttttcctgtttctgtatcacattacacactgaatgtgtgggagagcagagagatttaatttacaagttttagatcaagagagcataaccagatcccaggttaagacttaacactacagaatactcatgttagtaatactcgtcctataaaaagatacacttttcactgtaattgctgcaaacaataaaatactgtaaaataatatgcagtgtgtttgtgaaaggtcaataacatgtttatatttttgctgttgaaaaactacacaaaaacaaatgactacaacagcagatcaattagtatcagtagaattataccatcaaaaattccactgagcttgaatgtaagatctgacataaccagataattccatggcaggggaataaactgcatttacattctctttctaacaattagtgcaagcatatccagataaactatattgattctacattatcttagagtgaaatcacctaataacttcttcagtagtctttcttttaatttttatcctaattatccgtctgaaaatgatcttttaaattgggaaaactctgattacattacatccttcagttcagagtagcattgggtaaagacattttggctgcagacaaatcactctttcatagtcatcagctttcagaacattctaagactttattttccatctaaacttttcagttaatttgactctaacttttaattgatgttactgagcagcaaaggagcctgaaggacactgctttgtttggaaaaatgaagaaagaaaggaatgtaaatcctgtaaatgtaattctaacgaaatcaagataaaatatagtgtttataaaaggaaatacaattatttctaataactgtactttcatttcaaataattttcaacaaattagtgatgtagaataaatacaattccagaagaatccaggattttttttctattgcatggctttttattaaattatagctacttgaaggctttgagaaattgaacaccagtaaaactgcccttcttttgttaatatgttttgttttcttttttcatttttaattcaactagtcattcacaagaaaaaattcactcaggtaaacttttttgattattctttcatagcatttaacgcgtgttatttattgtagtcttttgtctatgaatctattaatgctaagaaactgaacattcctaggagtgtcctaataagaaagaaacattaacaatttcagctgtatttttacttaaataaatattcatatagtttacctttcaggatcataacaaacactttaattatataagaaggtttttgtatatacatcagactaccaagaagtcatatctgattttgtgcttttctactactcttcccccaaacacttgttcaaaaagtttacttttaaagggtctgaactgtgtgtcaagcactgacatcagcatgttacctgaattaactcattaaactcttgtgatactcatgtggtattagcagtgaagaaactgaagcacagaagcttcaagtaaaatgtccggttttagagcaactgaacagtagagtatggaagcccagttactgaccttgtaccattgcccagtattgtgaactgacctaaaaaggcctatgagatatcaacccattaagatccatgacataaagaaaattgtttgtcctacaatatcccaatctggatgaaggcacataaagagaatatgcttaagcatgatgacaaaaaaataagaaagaactgtgaatgaactttacaaaacagaaaagaacacaagggactttggaaccaagttgaaaattaaatatgttcatgtgcacataacaaaagagtgatcataaataaactgtgtcaacactgtactatgaaggtgaaactttctttttaggattagttaaaccttgtataagttgtaaaaaaatgcaaccacatatattgatgtactaaacccaatgtttcttttggcttatatactaaaaacaggaattccttcctgtaatgaagaaaaaacacaggcatcaaggagtaacaaaattaatgtcttagaatctaaaatatagaaacaccaattaaggctttttttacataatacatgcaaaaactgcatcagaatttacaaaaaatctacagcgtaattggttctggcaataagcagtcacattctgctggaggtaactttagtaacgtcaagcaaaggtcttaaaattatgacaggtggtattcatttaaaatactcttaagagctcttagaaatcaagaacacagtatctggacccttatccacactcaatctctttctaactgggaaattttgggcaaagttttaaactttcttgaacataaaatgcctagctagcaataactttagaaaatactaggagtttgtaaagttacaagaatcaaatgagttaataaatgtaatgtacttaatgtaataatgtgcaaaataataattcattattttaatatctaaattctctagcttgtagttattttgaacagataaatatatataattaaaatttctaacatgtgtttttgattacttatcatgtagaaaaatacagctttccagatgaaaatatagtatataatgtagaagtcacaaataatatttattaaactggaatgctatcattttaaattattttggagctcattaaagtaagtctgcactggccaactttttatttattaattaaatttttgcctagcacagttaatctccttttctaagacttaattcccaaatctatagcctttcttttcccatttggagatgagtgggagtactgttcctttcttgccaatcccttcctctattttcattataataaccaatatgcccttgcctaagcatatgcccccagttaataatacagattcactgtactgtctcaccaaatttaacctgttatttttggaaacagggtttgtttaaaaatgggtttgttatttcttaatacatgccaaatgtcatcagtatatcgtggtccagatgtattctaaataccaattgaaaaacattcttaaagctaagaacacacaacatacttcacagagtgaacaactgtgagaagcctggggattgtaggcattcttggaaaactattatttttttttccatgtgtgtcaagcatttgcataggttatatgttttatagctccagttataaaaatagggaataaattatattccctcacatctgtacaaaatagcaagaatacacatctacagaagtttaaagtatttactctttttttttagttaatacgtttcagaaccttaaagagagcaaatcataatacccattgattataatgtcacattttagttattacattattacatttacttattataacttttagaattttaggagggaaaaaataattctgagtgtgaaatttgaatatttgcaccctaaaaatttccaattccattttcaataatttagtagaatgtttcttagagaaataagaagacaattaaaaatatgaagtactactaggttttcaagtatattgcaaagccataaataatatataatctatcagtggtacaataattaatatattttttcaattatattcagttgtaagaactcaatgctcctaaaatttttaaataatactatataaaagcaactcaaatgatatcagctcaaattcatgtatacatctttgcagctaacgtcttttaaaattaaaaataatttaaaattttgtcatacatttatgaacccattttaaagaacataacatgtcatacaaatgttaatttaatacacaatgcattagtaaaaactgttctgtatacatatgtttatgttagaaaactatttttaaacagcaattcgattctattgattcatcaaattattaaatcacaacattgctaaactcaatttttactctcctaagcatattggaatctatgagaatatacagtagagataataatttgaatagaatttaacttatatgttttagcaaagaagaaataaaaactggaatattatgggtttctaacatgcctatttgtttgttagttttccttttaaaaatttctttatagaagcattttgagtgaagcccacagattatttaataacttattagttatttaaaaaagtctgccttgttgacaatgtggaaaacaccatagagtggggtcccccaccccaggagctgcagaccagttagctgctcataacctgttaggaactgggcctcacagcaggaggtgacctgcgggacaggtaatgctgggtggcattaccacctgagctccgcctcttgtcagaactcagagcggcattagattctcataggaccaggaaccctactgttaactgcgcatgtgaagaatataggttgcacactccttatgagaatctaataactaatgcctgatgacgtaaagtggaagagtttcacatactcccccatccccacaacccactcacccagccatccctggtctgtgaaaaattttcttccacaaaactggtccctggtgccaaaaagtttggggaatgctgtgttaaggtgaaaaagggtacatgtggtaattgtaaaaaaaaaaagttcaataaatataggaaaaaactctaacatcatatgtatatgtggacatatatacttacatatacatgattttctgatttgaagaatgtataaaaaatgagaaaatgacattgaaaacctttttaaggatcattcattaatatactctcgctctctctatatatgtattatatactatatagtatatataatatataatacatataatatatagtatattatatattatatgtaatacatataatatatagtatatagtatatatattatatacatataatatataatatatagtatatatattatatacatatactatataatatatagtatatatatttattatatacatatataatatatagcatatagtatatagtatatatttatatacatatattatatattttatataatttatatttatatacatatatattatatataattacatattcatatatgtatatataatatataatacatgttttatatatattatatatatacattttatatagacagggtctcactatgttgctcaggctggtcttaaactctagctcaagtgatccagtcttggcctcccaaagtgctgggattacgggcataagccactgtgcctggcccatagttaagtacttaagtcaaaactgatcattgtacctcctttctcttcctcgcttcattcttgaaaggaattcaacactgaaaaagaggtggagacttaactgagtcattcacaaataagaactttagaaaagtgaaaaaacatagttatacaaatcatttccaatgatttgttcatctttaaaacataggccaatatttctattttacccaactttactcagctgtaggatgcagtccagaaacatcttagtgtaagagtattttttcataaaatgtaagatattttattcaaattgaatggctgatcagccataagaattccactgtaaagtaaccaaagaagtacaattcttacaaaacaatcatgaaatagttttaagaattaaagaaaaagtaatcacttttcaccaggaatcaaacttttagttggcatagcataaaataatttctcacactggcaaaaggaaaacctccagaaacctccaggcaaatgtcctttccccactcccactcctaaagaaaatatgggctagaccgaggcaccatgatctctcctgcctcttggatttgctctctgtatcccagggctgtcttctagtctaatctcactcataaagctgagcaaatggcataccaagacagaggatctaacatgtgtttgaccttttggaggcatctcaagtccctggattccacctcctgttctccgtattttcaaacatgttctcgaatatgtgtttgacctttctgaagtatcactagtccctggattccacctcctgttctatatattttgtaatgttaatgtccaatttcatttttaaaatgtgagtttctacacaagttgtttcttatttgtacccgaagactttgaataggctctggcactcccagacatgggatatcaaacagatgcaggccttaagtaggtcataggactggacttacatacaagtggctgtggcttgtgagactaggttgtagtggtttttttgttgttgttttgttttttcattttgtctaaggacttgaaaaccttcaggggagacgtgagttaagatttgtcttcttctagtgatcttcttttaaaacacaaatcaatcctgttaaggaatccattaaattactattagtgcgaatggacttttttaggtagcatggatgaattcaatgtaaatgcaaatgtagtatgtggaagaagagccattctcattctatgaacataggacaaggatgagaatatatataacctatagttaatgaaaaatatatatttctgatttatgtgaaatcaatttaagagattacataaatatattctatagatataatatgattttcatcagagcacagaggatgaagagagaagagagaagataggagtggtggctactagatccttttgggggattatttttaaaaaggcagtttttggcaataaaaggggactaacaccttctaatagatatccactggcttgcagaaaacaaagtgtcagaaaatttatcattggagaaaagtcaatgtttccattagtattaatgtggctaaagatggctcaagggtaaaattattcaaaatactatgcatcacaatagtgccaccctgtggactactctctctctcaccctatggggaaaggggctatgtgaaaagaaaaagaatttctagcgcagcaaaacaaaattctttaatttttttacatagaaattgatagtgtttgctatcagtgatgtaattattttacaaagaagcccttgaactatggcagaacttctggatgctctgtcactatgtgtcaatctcaatatatcaatcataacacgtgtgatttggggttaatatgaaggaaaaacaaacttctcttcggttaagtatattttccgagatttaaattagtttcccaatttttttccccaggtttccaaattcttagtgtaacaccaaccaaatatcaaaatagattattagagtttcgatacaataaataaaattaaagagtaagcttataattcacattatttaattacatgcattattagagaggacatttcattaaagcatgcaagttgcattttttttttttaaattttgacatgtagatagtttaaactaaaagccagccaacactttgatatagcagaagacaactgggaaatgtcagttgactaaagtggttatttaaagaaaataaggaaacacaatattctttttgtctattgatatgtgatgctgtactgttattgggcaaactttttaaataatagaaaactctaatgcttacgatgacaaaaacatgttctgtaaaatagcactgtatatgaaaatagtacaaaagggggaaattagaactctgacaccacagtatcaatgaacatcacacagactgaagatcacagtagtgaatgaccaacatctttaggctggaaagagtgggaaaaattaagaatttcatggagatgttattttcaaaaatagactcaataaaatcaccaaactcaccactgggttcagaatgtgatcaaccatctctttcacttttatgttacctttgtggagttttattaatggaaatgaagaaatttactagaaaaacatgattgcaggcactgttaaatttactttctctttgtataatttcatgaaagtgacctgaactgctttgcagcattagtagggaaaaagataaatttatgaaattaaaaggtgagaatacataaaaagtttttatctttccagtgagaaagtgataatcataatgtttagttaaagctatcatctaaccaaacccatcagtacgctaattgtttttaacttgagattttaataatgctgaagtatttccgtcacctcagtattagtgcttccttgtttaaatctcaaagggccaccatccaaggctgcaaatatacaaatgataaaattttggtatttaagaatacccatcttctagtaggacagccatgacaataataatggctttgatagaagaaaacaagaaaatttcaagaagataaatactagggaaagtttttagattaacatgcaagtatgataccctccctcacaaaaataaagttcattaacactaagcctgtaaatttcatagaatacttcttgaactaggagaactggaatcacccatcctgttagaatgcaattaattggaccctcttgaacccgtatcttgtgtgtcaggagttgtaaatctgttaagcatcttcaggcactaaacaagatctgaatactaatgggttcatttatttcactgattactgtatgcagatatgaaattccaggcactgatttttcattaaaccactctcttaaggttaacttgcccctctcttttcacctgaatccatatgcttgccacgtaaattgtaatattgatttttaacatttccccacagttcaaaaatattgtttgcaaaaaatcaagggccttttctaacaattcatgtaattcctgttattagctaatgtgtaagagtagggaacaattaaacatactgtatacaaaatcttaccatcctgaattgcacccaagatattagttcagtcatccttcaaattacctcacaactaaaaaggatcagatacttaaataaaaacttcaggcaaggtaggaaagaagtcttttatcatccctgtatattgcaaaagtgttccattctctctaaattcacattatatttattaatgagcagcacatggaaagaaagaaaatgagagagagagagaaaaagagaaagaaggaaggaaggaaggaaggaaggagagaaggaagagaagaaaagataaagaaggaaagaagtcaggatggtaggaaagtgagagacagaaggagagctagagataacgatgagagaattaaaagagggaaactctaatgtctttgatatcccccaatttaaaagagaaggatgtgaccccctcccccgtttacatataatggaacaagccaagtctccattcactgcatgtggacagtaagaaaacttgcatggggaaaacttttggggggaaatgaaggtgatttccgagctgctactgcagttatatatgacactgacatttatttcccataattcttgcccacaggaaacacatcctttaagaaactgaataaaatcaagtttgacattctcataatctgcaaggtatcaacttccctgagaagctcacattcccccaaaacacacacatgtatgtaaggagcgagacattcaggagatgagctgtgaaaggtacttccacattgtgagggtgccaaggatttggttattcctgaacctgaatccgaaaagcgggggtggggtttgcgatgacaaatgagggtgagaagaatgtttccatgaaaccagacacccttttggaatctaggctgagaatcaggatcccacccccttgcctaccgccaggctccagtaagcaacctctggcgtcctcccctctgctccttccgcagcagcagacatagggatccctagcagccagggagcttaggtcccgccgagagctcctgccaagcgcttctctctcgactagttatcaattgagaaaaaaaggatcagactcacaacaaggatggtgatcaaaatccagtgtcaggcaccagggtcccagaaggttccggctcctcttctgcgcccttacccagctcttttcgcctcgcaaagggtcacccagggagccaccagcagcagatccttcccttttgctcctcctgatagcgccaatcttcgccaccactgccacactgcgcgcccgctatccactcacggcacaccgagaaggcctggcggagacagcgcagggggaggagggtggattaaaaggatagatttttggaagggtaagggagaaaaactttgatgttgtacccacacacaggactgagaagaaaccaaaagaagttgcagcttcaggagctgggaggacgctttcgccagctcggaaaaaaaataataataaatcaccccctaccaaaatcagggggaggaatcttcctgctccttgagcgatcactgagcacacctcgcaatctctgatcttcgaacccactgaaaaagcacaaggcatggggagtcctgttggttcacgcccggggtgcgaataccaaaagcacctcccgctggaaaggctgcaggaatctcgaggcaaagacagaggcaaacgcaacgctgggaagagcgaggggtgctgccatctgcaaaagcagagacgcgtctcccttcgggcaaagtgactgttacaaagtctgttccctcctgcgcaaggacagagacatttaaaggcctgaacggacgtcagcaccagtcgagctcgctgggtgagcgccaggtctccccaccccaaggatagcgcgcacagggcgatctgctgctcgcgaggtagagagtggcttacttggggagaaaacattgaatctgtaaattaccttgggcagtatggccattttcacgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcatttgtgaatgggagttcactcatgatttggctctctgtttgtctgttgttggtgtataggaatgcttgtgattcttgcacattgattttgtatcctgagactttgctgaagttgcttatcagcttaaggagattttgggctgagacaatggggttttctagatatacaatcatgtcatctgcaaacagggacaatttgacttcctcttttcctaattcaataccctttatttccttctcctgcctaattgccctggccagaacttccaacactatgttgaataggagtggtgagagagggcatccctgtcttgtgccagttttcaaagggaatgcttccagtttttgcccgttcagtatgatattggctgtgggtctgccatagatagctcttattattttgaaatacgccccatcaatacctaatttattgagagtttttagcatgaagagttgttgaattttgtcaaaggccttttctgcatctattgagatgatcatgtggtttttatctttggctctgtttatatgctggattacatttattgatttgcgtatattgaaccagccttgcatcccagggatgaagcccacttgatcatggtggataagctttttgatgtgctgctggattcggtttgccagtatgttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctgttagaattcggctgtgagtccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgtttcttctctctttttttctttattagtcttgctagcggtctatcaattttgttgatcctttccaaaaaaccagctcctggattcattaagtttttgaagattcaatgccaaccccatcaagctaccaatgcctttcttcacagaattggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaatacagccctcagaaataacgccacatatctacaactatctgatctttgacaaacctgacaaaaacaagcaatggggaaaggattccctatttaataaatggtgctgggaaaactggctagccatatgtagaaagctgaaactggataccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaagaacaaacaaccccatcaaaaagtgggcgaacgacatgaacagacacttctcaaaagaagacatttatgcagccaaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaaataggaatgcttttacactgttggtgggactgtaaactagttcgaccattgtggaagtcagtgtggcgattcctcagggatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacagatacaccatggaataccgtgcagccataaaaaatgatgagttcatgtcctttgtagggacatggatgaaattggaaatcatcattctcagtaaactatcgcaagagcaaaaaaccaaacaccgcatattctcactcataggtgggaattgaacaatgagatcacatggacacaggaaggggaacaacacactctggggactgttgtggggtagggggagcggggagggatagcactgggaggtatacctaatgctaggtgacgagttagtgggtgcagcacaccagcatggcacatgtatacgtatgtaactaacctgcacaatgtgcacatgtaccctaaaacttaaaagtataataataaaaattaaattaaaaaaaaaaaagaaaacagatctggtggcgctgctgagtgtcaaaccctggagcccatcatcaagacgttatactggtggcagttctgctgtgagtgcacttgccgaattgaacagagccagagctgcgtggagagagagctggccactctgcacgcgcgcagccaatattgggttaccaaggagctcaacacctggtttttagaaaaaaacacttctctctttaactctggtttgagtcagtattctgatttgcttctgaaagttagttgaaatccatcgagatgtctttcacaagaaagggattagactttcccgtcttggaattccaatcaagataatacttaatctttccttaacccccactgtgtacttcctaactcacagtcacaatggatgaaagtattcaagcatcttcaaatgaccattaccctgcattctaagacgatttgcctacttagacgtcctttagtaactgcaaattatattttttcaagttcgtttgccagctggcttcagatcaggttcagtcaatgaaaactggtgtgtaggaaattggccggtgcccaaagagtaacagttaggttgttcctcctcctttgcctctgctatgggtgacatctacaccattacctgtcctctaagtggttctagcttccatcagggaatgctggctccttgtctttagtagcttgaccttccccctttatactttcaacctgtttctgattataatttgacttctcatataatcagagggagacaatttactgatttcaatcaattactattctctatattttatttatcatactataagactgcattttatgtgtgttttaagcatgattcagccactcaaaatttgacaagagcagcattggtatcttccaaaaggaaggtcaaatcctgctgtgtggtaaactaattaccataagatctacaaactacaggcttagggttttactttgatgactgttatttttataattctgagtatcagtgttcaacatatttgatggctatcctcatcaaatgatcctaatttatttattcactaatttatgtactctttgaaaatatgtattgacatcttctgtatccctgtcctcatacatctctcagttttgttgcaacagaggaaagaatatggtgaaacaaggagttggccccttcttgacaacttgtgcagacacaagtgctttgaatggggaagagactgggaatgcaattttcttagtgtggtgagctattctgcaatattataacagattcaatatctaaagagctgcaactcaaaatgaataagataaattgaagtgttgtgatttaagtgcaaattaaactctcaaaaacattaaaatacaggttttgcctgtaattaacaaagcaaagagagagtgtaaatcttatgcagcaattagattggtccatggtaaaacggaggtagctggtaatttatttttctatgttggggaagaaatttaaaaacaaatatagtaaacagcaattaatgttttatgatttgtaaataaagttatatttttaagattgaagcctctcttaccattctcaaagagccatttcaagccttgaatctctcagggcttcagtctgaattattataactttccagtttgagaacatttttcatttattcaacacttaaattgtatgagattatattttcaggaacaattatgtttattttttatatgaaataaaagtggacaaaatattaactgataattgtaaaagtattacaagaaatacaaggcatattataattatgtgtcaataaaaagagaaatgcctgtaaaattataataaatcattcaaatatcttaaaagcaaaatgcataaaatgtagaatgtatatattttcatttgaatgaccattttttaattaaaaaaataaaaggattcttaaaacattcaattagaaactacggattttcagcttttcccgattctattagaaatgtaaaacaaaataaatttaaattcaaaaacatgacagacccttcataatgttttctctgcctactcattccatgtcacttctaatttctccctccatacaaaatatgttgaaatcatactaaatctttgccttctgtgcttttattgtaacacactccatcatctttacagttgcaattttctgttcatataatttgccttctttcttccattttatggcttagcatctttttatctttcttggatcatctaaggtttagttttcttgtggaaatttacattggctgcacttcctagatattcccattgggcgttgatttcctcttatagcacttcctccactgcgatgtgttgccacactaactaacatagctaacctgttatacagtaagaactgttaggagagagttaggataaaaagactaaagtgggtagagttagggtttgggttacaatactagctgtatcttgatttgctagcatagcatacatactagtcaacaagtatatatgtattgaatatacctataaataaatcaataataacttttaaaacatagacctttggtttgtatcttataaaaagcttccctaaaatgtatgaaaggtctcactgactttatgaaatatacattgctctgatttcttatttatttttatttatttatttatttattttgagacagagtacctctgtcacccaggctggagtgcagtgtcacaatcttggctcactgcaacctccgtctactgtgttcaagcaattctcctgcctcagcctcccgagtagctgggattacaggcgcatgccaccataccagctaatttttatatttttagtagagatggggtttcaccatgttggccaggctggtctcaaactcctggcctcgtaatctgcctgccttggcctctcaaagtgctggggttgcaggcgtgagtcaccgtgcctggccccttgctctgatcttagtcttcttaggctctggtccttaatatttgagaatgtctgacaggacccgtgaattttattttttaaaaattgtatatgcccaaaatttgcatgcagtttgtatggaattttgcaaaatgtatggaaatcctgaagtctggcttgtttttttcttttttttttttttggcagggtctcgttctgttacccagactgggatgtggtggtgttatcgtagcttactaccttgaactgctggactcaagcaatcctccaggctcagcctctgagtagctgagattaaaggcatgtaacaccatgcccagcttattttattttatttttttcagagacaaaatcttgcattgttgcccaatctggtctcaaactcctgtcctcaagtgatcctcctgtctaggcctattaatcccaaagggctgggattccaaacatgagcggctgtgctcagccttgaggttctggctgtaatctggctgttatttatggaaacaacagaagttcttggtattagcagcagtcattcttcttgagagagtcaccccacaagactgagatgaatatatttaagaacccaaaatgaggtcattatggcagaacagaattgatagtgcacattaaaagacattacacactttgggtgattcaactaaatcatagtctgaaatgcagttacaaagtggtaatgttcaaaagatcatctattagtcaaagttacaaggaaagtcctggttatgttggtaaaaattgatatctgtgattatccatcttcaaatgatttgttaaatgtttattaagataaaaaagttacatttcaaaagtatttatattatttgtcaattcctccataacaaattatcccaaaataaagtataataataaaatttaaaaaaagatgagaaacatattcttcaccacaggaaaaaaaaaacaacctttattatctcaaagtttctgtggtgcaggaatctgggcatggcttaactgggtcttccattcagagactctcacaagttataatcaatctcactcacatgcttgatggtgtattcagtactttgacagctgttgtccagaattccatataatgtgagcctcttcggtatggaaggtttcttcatcaaaatgtgccaagccaaaaaaaaaaaagctattgaaaagagtccaagacagaagtcacatcttttgtcacctaatcacagaatcaacctctcatcatgtttgctgtattctatgcaacagcagcaagcctatagatccagctgacacccatggggaaggtattagacaagggttggaatcccaggagatggagaccattagaaacaatattaatctgctgattacagtagtttgccaaagaatcctgagataataattctgggctcaaaattcttatgaggcactgaggcaggacaataaaggaacagaaaataatactatattaattttaatgatttattaatactaatatactggtataatgtgctaaaatagtatactacatttttggtaatttgtccaggagtaatagaaacaaatccaaatattaaatatcaaagcatattataattctatgataattaactctgtaatttaaaaagtctaatataggaatataccaaaaaagaaagttttaaaaatatactttatttcctaatatatcaaaatggagccttcacatatgaaattagtaaaatatttttgacctaataatttcatttttagcttttctcttaagaagtcatattgtttgcaaaaatgttatgtaccaaggagtttataacatgcagttgtagtcaggaaaaattttaaattaaaaatgtgcaataaatatatgtaaaaacagaataatataggcatctaaatagccctatataaaaagacaaacataacattacaaattagcattaaccaaaaatatgctctgaagtacatcccttgattaaatttacttaagtttcttttggaaaaaaataaaaataattgtatttgctagtaagagaaggtagaacattatttgcccatttgttttcagaagtaaaacaagacatttatgttttcagaagtaaaacaaatacaatattttctaagtaataaggttgagacaagaaaaaaacagcaatgagtaaaaatgtctatttacatgcttttacaggaaaacaagacttaactactttcttccaaaaaaaaatttaagtagaaatgttattgttttactaaaagtaaatacattttacatacttctctcataattttaatctgaagttcagttatggtgatcatattagtcagtgttttccagagaaacagaaccaacaggagagaaaaagagacagggagatgaaataaggcattgtttagcatgattatgggggaaaagacgtcccaagatctgcagtcagcaatctggagactcaggagagatggtggcatagctccagtgtgaaagctggcaggtttgacactcaatgaaagccaaagtttcagtttgagtccaaaggtgggaagaaaccaatgtcccatctcaatgcattcaggtaggaggaagttccttcttactcctaggaaattcagcctttttattctattcaagatttccactgattgatgggacccacccacatcattggggaagtctactttactcagtctatgaattcaatagagaaaaagatatacataagctatcatttaaatttttaaaaaatcatttctaatcaaaatgtagcattttaattgtgtttttagagttttgtaagtgtccttaatttttcagcttattcttaaaaaatcaatttcactttattcaaaattcccttttggaaaacattaaatggtggcccatataatcttagactttacatgctttttgataaatataacattaaaagtagcatgtgtagtaatttaaattacatatataagatgtacatatattattctccagaggaaataaaactgttaagaactctgatttagtcagggttctccagagaaacagaagtgatagaagatgtgtgtgtgtgtgtgtgtgtgtgtgtgtgtgtatacatatatatatatatatagagagagagagagagacagagagcgagagaagaagtgaagagaagacatttattaggagaattggcttatctgatttcagaggctaagaagtctcataataggccatgtgcaagctggagaaccaagaaagttgttagcatggctcagtccaaatccagaggcctttccagactttaccactaatcaatacactatatttagaaaggtatcataataagtctctatttcaatttaaaattctctattttcagagacaatgaaggacaaagggtcaaattttacaattattgtgaaaagagattatagagaaagggcctggataataccaaaaatagaagaaagaaccatccatctggggcagagaatcagcagtgatattacttgaaatatggaaattaataatatgtaaggttgagtttaagatctaaaatataaaagttaaatttaaatctaacatatatgatttaactctctagaatatatctactcaattatatgaaacaagcgggctgattctcaatactttatcaataataaaggtttttccaaatagttttgaagaaatatcaaagtgtctaaaaaaaaagccttagaccatgaaccatagagaaaaagacaaggtttgccatgaaaagtgaataacctttttatttccagttgtgatgtgttgatacaaaccattagcactttcatttcagtgaattatgccagttcttgctttaccttgtcaagattatatatatgattatataagccaaacatgcttccaagctgtaactcacaccaaaataataaagactgcgaatgaacgactatatttaataaaaaacaaaatcatacacttattttagatttgaaaatgtttgggcaataggttaattagatctcttttgagtgttttgtttgggatgtgtgtgcatatgaatctgagtgtatgtctttgtgtgtgtcatcagctcaacccaccttgaagaaaaaaatatgataaaataaataaataaaatatatattatcagaattcggtacagataaaaagtacaaaatttgatgaagatctctgtcttgtttatcattacacaagaaaggaaaaaattggaatataaggcaaaaattgtttgttcatactagctacttttgaacactgctctgcccaacaattttgcatccattaaaataaatataagaatcaaatatttcaaagcaatgctataaaatacttgtatgtagaaatttgttgatgccctcctcagcatcctgtccatgtcttattttatatcagcacaattcacaattgcaaaaacatgtaacgagcccaaatgcccatcaataagtagattaagaaattgtgatataaaaaaataaatatatggggatactattcagccacaaaacgaaaaaataatggggattcacagcaacctggatggaatcagagactattattctaagtgaagtaacgtcagaatggaaaaccaaacatcgtatgccctcgctcgtatgcgggaactaagctatgaggatgcaaaggcattagactactacaatggactttggggacttgggagaaagggtgtggggcgtgaggaataaaagactacaaattggatagtgtatactgcacaggtgttgggtgcatcaaaatctcactaatcacctctaaagaacttactcttataatcaaacaccacctgttccctaaaaacctatggaaataaaataaaatgaagaaattttgtgtatgcataccacatattttttaacttttttcacaggttcattgagatataatttatatattatttaattcactcatataaagtataaaattcaattttttagtgcattaagtgggtgaatatgcaatcaccacaacataattctagaacatttttatgctccttaaaagaaaccttgcgcccattagcaatctttcctcattttccctactctttctttaaacccctcccagccttaggcaaccatccatctacttcctaactaaggatttgcctattctggaaggatttgcctatcctagacatttcatgtaagtggaatcataataatatatagttacatgtgtctcactactttcacttattatgttttcaatgttcatcctttttggagcatgtattaatacctttttctttttcattgccaagtaatgtattttatggacaggccacattttattaatctactcctcaattgatgaacatttctgttgtttcctactttttgttgctataaatacttgtatgctactttttgtgtagacgtttgttttaatttttttggtgtacacataggagtgaattactgagtcacgtggtaattctatacttaaacttttgaagaactgtttcatttttctgcatgatgcttgccaattatcccagcaccatatattgaagagtgtcctttccccactttatgttttgtttgctttatcaaatatcagatctgtagattgctttgggtagcattgagattttgacaatattattttttgagttcataaatataggatatttttctatttatttatgtcacttccaactttcatcaatgtgctataattttcagtatacacatttttcacatcctacattaaaattactccttagtattttatttacttatatatttgttttgatgctactataaatgtaattactttattaatttatttttcagatagtttatcatgggtgtttagaaacaagaatactatttgtatgttaattttgtaactctcaactttattgaatgtgtttatcagctttaacgggtttttttggtggagtctaagattttctttatgttaggattacattttcagaaaacacagacgatctcaccccttcctttcctatttggatgcctttcatttcttggccttgtataattactctggatagtagattacatacaatgttttcagcatttgtaatttgacatgaaatccatctgttgcaatacactgattttcacttttcaacttgaaaacctggacatttatcactactctccctttctcttggtctagtccttatttaaaaaaaaaacctaccaatctaaactaggataattatttttctataaaacaatttcaaaggcatttaaaaaatttaacaatttttaaactttctatgtcaatgattttaaactgcggtctctcaaaacaaatccaatacctttagtaggaaaaattatgttaattcctacactatcattgggtctagccaagagttgatattaatagatatgcttatttattaccttgttctaacagttgtagtgtaagtcttgaaaatcaagtaaaaatttgtaaagattataatcgcacaaactccctctctcatgaggcacacagttaatccaaaatattatttctaacttaccataaagccaacaagtaaatacaatgtagtgtttaaaaataatcataagtatattctagaaatgaaacattaattgatactatttattgaatatctcatatttatttacatagaaacaaaggaatcaaaagcatattatgtaacattgaaatgactaaaaatacttgagatagcattgctacataaatgctatgtaaatgctgacaaaagtaaaaatgccattcgctacatttgctaaacatactgtgacacattataagtattttaaagatatatcactaatgcttgggtcaagtgggcaaaaatgattctaagtatttaattgtggaaaaatttagtgcaggggatagtattcatgtgatggaaaaattttaagtggaactcagagattagaagcagcaggaagttttaataacgtaccaggtgcagtgtataggatacaagacagaactataggtaaagtctgagtctttccagcatagctaggagacatggctaactccacctgtccccaggccttacctagaagttgaacagctccaaaccaggtaaacagaacaattttccaaagtcaatcaatttatgacgttaaagcacttctaaaatttaacctctgacttaaattagacaaaatggataaattttgatgatttttttaccaatgattttaacactgtctttatttcccaaagattactgaagtcatgtgaaataaaaggcattggagattctatttttctgacaaaatatgtaagagccttccttttcttctaagccaagtaattagggctcctttatatatatacatacatacacaacacttctagacaggaaacgatctagcagttgtaagtttttctttctcattttatgaatcctaacacaacttccatagaccatctatgacatgaactttctgacttttcctgtatttccctctttcataattagtcattctactttaggacaagaatttgccatacaagatcctctctcttgtaacatttatttccttcataactttcttaccataaatacatcttcatatccacaactttctttacatctccctccccgactgatttctgatccccatccaaacctaaaaggtcagataacacaaagcaaaacaagggagagctttacattttgagagagacctgtctgcctgaagttcttgggattccatgaggacaaagaggtttctcctaaaatgggttttgtagcaccttctgtttttctttaaggagtcccagcctgtcagaaattaccttagatcctctcatgtgggcactgagtggcaacaagacagactagggaacactggcaacaagacagacaactgagtagaaaaagaaaaactacagtccccactgtaaagatggataaactgaggcatcatgcagtttaaaaatgcatgttacatagagttgggctccacagctcactctcttaaccatcctgtaattttgcctaacctatgcccagtcactgatgcacctgtatggtacttcatggcccccttagagcttagaacctgggtttcattcctgctctacagctatataatttaacaattttcttctgaatttgttggattctaaccctatgcttctaaaattttattaatattactgaatcttaaagggagctttaagatgtctttagtctttagaaatactaaacctataaacaaaggactatatgaagttaaaactgtattcaaatttctacatgttttaagacactgaggcaacgtattaagaaacacacctaagacaatcaatctactctggacaaaaatttagatatggtctcttctaaataagctacctagtggtatttatacatattcttccttatatcaaccgtatcttacatgctcatagccttaaaaataactaaaaagtgtcagaattataggccttacacatttctgttggcttgaaaaatgatacaaaatgcataaacttctagagtgatcagtttaaaaaaggagttcataccaaaggtagtaatactaggaatcaaagagggctaaactctgcaggtttttaaaggtgaaagttaataaaaccttgtttttcattgtgaatctttgccttacaacattatacacatgattcttcccccttctttttcctcttgcaaagatgtggtgatgaaccctttgctcatgcagatgacaatactcttgaaaatggtggcagagaaaaaaaatgaagggaatatggttcacttaatcatctcataaattagaacttattacccctgtgactcctgaatagctccagaaaaaatatgtgagagacatgaaatggctgtttgctaccaatattttatgtgatgcttcattttttgattccttgaagaacacaacgcattagcccatttatgcgagaggttgcaactttttgaatttttgcataagtgaaaaattagaccttgtcgatgacatttagcagtaggatacaagtaattcccacgtgcttggcgtggaacactaggcataagtgggttaacacaattacgaaagcatagctattcaagtaactaattatacaactgacttttttttcctcatctctaaaacatagggatcagttatttaaaaaacacagtgacaagtattttatttttaactcagttttggtttgttaagggcgttgcttggcataaaaaaaacaaaaacaggaggagaaacaagaatacaaacatgacatagaagcagtagcaaaagaaaatgaagagtatcaagaaaatgagaagaaaatacacaatggaagaaaggaaaaagaacaggtgtgggaattaaaaggcctattatgataccttttatcccctcctcgattcataaaatttgagtaactccaagagtatcacaacaaaaaacaagcaaaaggatacacaaatagtcaccccctaaatttggttaggaatgagataatgctgccactcaagcctagctcgggcaccagcaggaggagggcaccctccagagactgcaggagaagggggaggactcctctttgccctatatgtaccaccaccactgccaccgaggccttcgttacaacacccacaggttcctccccaccccagaacgggatgggccctgcagtgctcctactcccccttcccagcccccagacttcctactgctaccaccactagcgccgatgccaatacaaccactgtcaccctcaatgtaccagcccaccctaccaggctcctaccacctggtccccgtgggtgccctcctaccgctccagttgagctgcagtctccatctctaccaccaacttcatgaggcaagtttcagagccatgtcatctgctcgaccataccactggcgactcctccttctcctcctgcagcctggcttggagcagctgggcaggcaaagctagaaaagcccaaaacgggactcagggagtgcaaccgttagagcctcaccttgtcatgctggtgactgggtttcagggatcagtttcattgaaggcactcacacccacttccaaagtccagcctctcctcttctggcaaaagctggccaggaactggggcctggggtgggagtgagtgccttcactgaaaccagcccctggccaagtccagctggccaggaattgctgggcccaccaaggctgccctcctcagggagcctgagtaggagaaactcagacccagccagccctccccacccaagagctggttccctttcctgacacctccacccaaagtgccctgtcccccacttcccccatggtgcctcctactacctacccggtagtcccaggtggtcttcccaacacagagcatgagggcgggccagaaaaccacagtgggtgtgggggccctgccctgcaatctagctcgagcgggagaaaattgccttctagagtctggcatctgagaagagaacgatcccttacttggagaccaccagaagaaggaggccactgctgtcactgccgccaccacctcctcagctcgccagcgccactggcagtgtagcccccatagcacccctaatctgccccctgccactagtagtgtagcccccggatagcacatccaacacaccctagtttcaggcaatgtaaccccaatatccccctaaagcactccctccacacctcagggagcataacacccggtagttctcacaatctgacccagccacaggcagttcagctcctgatggcgcactccccagtcacaggcagtgcagcacccaacaacgcccctaaaccaccgcccactgccagcattgtagccccggataactccacccaacccaccccctgccgcgggtagtgcagcagaagatagtgcccctaatccttccccagccacctgcagtacacattagtgtacacaatctgcctccccgacaccacccctgccaccatgggctgtatagccccggatagccagccaacctgccccactaccagcaatgcaacactggagagtgcccccaaccagaccactgccacaggcagagtagcctctagcagtgagcgccaataggacacccaacccttgtccccagaggcatacggggcagcctcagaaaactcacctaccccatcacatttctaccactgtggccgagctgcagtctctgacgtcaccaccaaccacagcgaggtaagccacggtggcacaggctccagcctccagcatgtggcggttcctcttcgttctagtcctccagcccagcaggagaagctcctgctgccggctgccctcctactgctctctcgccaccaccaaccgcagcgaggtagtgtcccaggctccaggctccatccatcctccagtctccagcaagcggaaggttgcggcctcttccagttttctaagttgggcacagagcagctcctctgcttggcacagaagagcctgaaatgacgtgacacgacctcagcatgctttatataccgaggttaatgcaaatgtggttcctggactacatgttctgataggacgagaaaaaaacctctaggcctactctgattggactttattttcatgctgtgatttgttgtgttaagacttgctctcatccaattacaacattataataaagtccaatcagagtaagcctggaggttttttctcatctactcaaaacatgcagcccaggaaccctcctgggcataactgcagtatataaatgatgctgaagagggatgaggttttttcgggttcatgtatcttcctgtggagttgctcggtgtagaggactaggaatcaggagtcactggcctcctatgctaggggctggagccgtgggagcggcggctcacctcgctgtggttgttggcagcgacggagctggcagcgcggctggagtggtaggagacggaaaacagttttaggatagatggaggggagtaaagagggtagatagtgccaaagggaaaaaaaggtagcttagtcagagaaggagttgcaaaaaggtggtagtgaaaagatggtgggggaaaaagtttttgggtagatggaggcagaaaaacagggtggggagtgggaaggaaggaaggttttgcagaaagacggtgggtaaaaagtttaaaggtagatggagggggaaaagagggcgtcaagtgggaggaggaaaaagagggagatgatgggggaaaacgggggtgagcagtagggagagaaggtttcgtgaaaagatggtggggtgaaaatagagtggggggggaaggtttttgggtagaggagcaaaagagggcagcaagtgggagaaggaaaaagagggtagccagcaggaggaagacaaagttttgtgaaaagacagtggcagaaaagaaagaccatggacaaagaaaagacggtgggtgaaaagtgtttcgatagatggaggggggaaagagggtgacgaggaaagagggtagcaagagggagcagggatagagggttgggaaaacgacggaaaaataatttggggtagatggagggcaaaaaagagggtggcaagcaggatggggaaagaagagcatgagcggtaaagggaggagactttgaaaagatggtggggaaagtttttgggggtagatggagggggaaaagatggaggtgagcaggagtggggagaaggctttgtgaaaagacggggggtggaaatgtttttgggtagatggagaagggaaagagaatggcaaggaggaacgggggaaagatgatgatgagaacagtttttgggtggatgaaggggaaaagaggttggtgagcagcaggagtggggagaaggtttagggaaaagacgggggaaaatgtttttgcttagatgaaggagcaaaagagggtggtgagagtgggagggggaaaaagagggtggccagggtaaggggaaaagacggtgggaagaaactggggaaagggtttgggtagatggatggggaaaagagtgttgagcaggagagtagagaaggctttgtgaaatgagggtgggcaaaaaatggtgaagtttgggggcagatggcagaagaaaaagggtggcgagagggagggggctaaaggcggtcgggaaaagaaggtagggaaataattttgggggacaaaggtttggggtagattttttaaaataagattatttgtatttttgattttgatgagttctttattttgtgtatgaaccccttgcctgatgcatagtttgcaaatacttgcttccattctctgggttgtttcttcatttttaaaaaattttaatttaatttttttttgacggagtcttgctctgtcgcccaggttcagtgcagtggcacaatctctgctcaatgcaagctctgcctcctgggttcacaccattttcctgcctgggcctcctgagtagctggaactacaggcgcctgccaccacgccaggacactttttttgtatttttagtagagacggggtttcaccgtgttagccaggatggtctcgatctcctgatctcgtgatccgctggcctcggcctcccaaagtgctgggattacaggcgtgagccactgtgcctggccttgaaacataactttattttttatttttgtatttgtatatatactttagtagccctgagttttaataaagttgcctttaaaatatgtatcttatttttcagaaatataccctaaggcatgtgattagttgggtggcatgttctttagtttttacaattgaaggattgtcattcctttatacaaaaaaagtgaatttttatcatatgctagaggaaagaaggtagatactaaataaatactgtatgcttccatgtagataaaatttgaaattatataaagacacaataccttaaacttttctggggttaaagtggggaatttcattggcaaagttcatgcaataaatgtgtaggtgaagggaacattccatatttgattatgtaggtgattatcaagctttataaatttataaaactgaactggactaaaatgtgtgccttacacgcaaattataattctataaaattgattaaaactagttagataagagagaatcaaggggaaaagagaaaaggcacgtgaaaaaataatgccaatgcactagaattatctttgatgacattaaatatagcctggtcttctcttaattctttttaaaattaatgtagatttctcaatcctttgatactttttcctgaacgcatcttatattctcatacatgttaatgtatggctacataggagaggattcttttacagctggactggaacagcttgatatttatatctagagatgcattggaaacataacactgacccgtgagcaagatgaaaatggcatgtgctagtgattcattaatatgttgctttaagtttagtgccaactggtctacatcgttgagaatgtttagtttgatggtttacacaacttgacttaagaagtgtatgaccaacagtgtatgagagagcctgctataaagacttttctgcacttcccttaaattattatagtaagctcaaatcttgaaggttcagaatatacagataaaatgtgtccgtgaggctgagaaaggatctttagggagaaaggctctgttcctgaaagacagactttcaatgatttcctgcattttatttctgttctagtttacctttacctttattaatcactaataaggtggttcttatagggcctcataggcctttttagttttccaacctattcatacttagtgcaaacctagtaattttttgcatgatagtattgggattttactctgaggctaggcttcacactgtaaaaacatctttttggaattgtatcattttcagtctttccatcgtgttccactgtcccagccacacacacaccagatatgaagactacaagcaacctcaaaaagtaacccatctatagtagatgtttttacctcttgtgaaatctaaggaaaatatactaaaaatgaaggcatcagtaaaacagtatcattttaggttgacctcgagcatttcaacatcagtctaacttcagaataatacattagcaaggagaaatggggtacttttgtggttttttacacctgttatttcaattgaaattgaaaaaaaaaactaatttgaactaaccataaaaggaaggttttatcagtattgaaataaaataacagaaaatgcatttgtgggtctgacctcaggaccgattttaaatagtcaatccctctaactctcattcccctttctctgagcattagctttattcttattccatcttacttgatgtggcactgacagatacagactcgttcttacaacatataccatcagaagtgaaaccttcacactctccaactcttgaaaaatctgagatgcactttgactattctcagattatgggtatattacttggatcaaaaagtactgcacagggaagtagatactgtaatctctgacattacagtttcaaggttggagtgagaaagggatagctccctaacaagggagtatcatagaaatgatattttcatggtcatacttctgtgaactaggcagacatcccttcatgtcaactacatctctactctactttgaacagataaatatccttgcatatacaaaattatgcagtagtgtaagcatgacttttcattaaaatttaagcaaaacagtctatttaggtgaatacatactgatacaggagatagttctgcttgaatgatctttacccttggggagagatacataaaagaatgtcatactttattatgatatgactatccagcatatttatgagtaaactttcataatacctttctctattgtctaaaataagcacaaaaacccttttagttaattaatatccctttttaatatacagaataaatagaaaatagcacaaaaggtattatgccagcacacagaaatagttccagttaaaagtcaatcctgtattttgagaacttgacaaaatcataattgaaaatagtgtactatcttacatgcagatgttgtgtaatcagggacatccaaatcaacttacatccaaatatttcacaattagtttttgaaatattctgtgaagtattataaaaccaggccctcaggaatataaaagcacaaagggagccaggactccaaatagccatttattcatttcctaaggttaggtacaatgaggactgcatttttaacattatcagggccatagagacattggagcttaaggataagatccaatttcatagcagtctgttaaagtttaagccagtctaatgacccaaatgttcaccataataattaccatcttgagtgatgatgttatgaatacaaaggaacactgcatctctaaaataaactacgtttatatgacatgagaccaatttgatggaaagaaggcaaaactgtgaatggtaattttgttttaattgttttcattgtgtgtactcatctgaaaatataataccatgtaattagaaaagttatcataacagaaaatagactggaaccttaactttttatatcaaatgttctgcacacgaatatggcctcctactgatgatctatggctccaaaatattggtagctataattatgctttgtaaaacagaagctgtgaatgtcttactacataaagacacaaagaatcatttccttactcattcactgctagtagaccctgaggcacagcatttcctgcccagatacctgattattaatccagtttttgttaggggtacactaacgttaactaacggagattggtgtttaaaccagttaatgtaaagaaatgctgtaggaactgaaatattccttttaaattaacaaaagtgttctttctagatagtcaaagttacatgaggacccaactgtataccagaaaatcatttgatgaatatggaattaataaaataatgttttgttgtatggttttagtactttgttggtgccaggttaaagacatgtggccctagataggataactctacagaagagaatttaatttgtttgcctgcttcactagaaatccaacaattaagtcagtgactctattttccaatattcatttcctccattttttcatctctttttgattgatggtatcatttcgttattttattttcattgacatggaattcattttggctaaaatgactttttgactatttgtgtatatatatatatatatatatatataattttaaaatcaatggaacaatattgtttctctacttccaagattatccctctatattctctaaagtcgataccgtgaaacagtccagatatgagtctaggaatggcagtacgaaatactgtaaaactggaagcaacttagtaggtaatcagtagggaaaatgaaactcaatataactgactctatttagttaatgtaatgatgcatttattttatatttttcatacaagtatttttttcatattttaaaatttcaaagttaagtatacatgtgactacagtcctcgcaacttctttaaggtactttatccggcagtcactagcagatgtgtttgtctaattcttagttttttttctgcctcataattttgttcacatttgctgtggagattttagaaatcacctagattgtttggtacaggaaggaaatcaaccctgggctgcctaattactgacaatctgtgtttctatggatacacatacattgatgattttggttaaccctttccacaaacagtcatacgtcccatgatagcttgctgtatattaaatcaaactttttatattgaaagtggataaagtaagccaaggtgttccagaagaaaatacatttggttctatatttttaaaaataagctatagcttgaaagtttcacctgcagtcctaacaagaaacaaattgggataaatagtccaaataaatgaaacacataaaaaaagaatctatatcaagtgtaataaattgtttacacctcaggtttttttctgctttgaaatttgtcttgacgtttgaccacatacatatttctgttgtattcacttctaaaaatagaacaggaaagatgtggacaacaaaaataggatatgaattgagagaagacgtgaactctcagaagaggagaagaatggcataaggataattagcatcgagatattgaatctcaacaaactaggacatggtggtgtagataatgatgaaagcatgcttgatatgtaaactagtaatttggtcgagcgagtaattttgacattcagatcaaatacaaataatttaataaaattagaccacaaactgcatagtgtgctcacataattgttttcattttttccttgctccgaattcaggtctgacagaggaacagataatacaaataacagttgatcccttacatcatctagctagacaaaatgatgcatatatactaccaccaatggaagttttcttcttttccttatatctttaatcttatttttaaattttatctatttcaatttataccttttatttttttttattacctaaaatgtgctatatgaataactttcagggaagcttggattaatgctgcatttgttcaatatgtgacattttccagttcctccataatattctagttaagtgtgtatggcccattaacctcctcctttgtgtttcagtgcacagacttctgtcattaatcatctgtacaactaaaaattcagttcttttttaaaactcacatcagactaaaactttagagatttgacaggcactggatacttttttattttcaaaagaataatcaaaatgtctcataactatcaaaatgaggcttagatggggaatatgtttaagacagactttgactaggggaaaaaaagagaaataacaaatccttgggtccaagtactccagtgacaagcttcaagtataaatgcaaatccttttagttgaatgagttacttattctagtttaagcagataatgctgatatcagacattttggtattatataattggtaggattaataattttatagaaaattggctcatttatctttgggatagcatgagatattaaaattaactctagaaaagagaaaataattttacttcaatatttccagtacatcttttggggcgtttcattttttaaggtacgtttttggaactacctgtaagcatatgataacaatatcagcacactagcaaacacactgttaaattttgtgaaaagacttattggcttatggattcagacatttacaaggttactatatccctcactaagaaagcataattaatttatcactgaatagatagactagttggcttttttttgaaagcccagagattatattaatttagagaatgaatataaaattgctttgcattttattgctatgggaataatttaaattgcttagtgactttttgctattttgattttgtggtggtggtggttgctgttaaattctttcattctagccatattttctcctcccaatttttcattcatttattaataatacatttattaattcatttattcattattcattatgtgaggaaacattgagttggaccacctgatgtagatataaaaacgaattaaatttttcttgccatcaagcataattgaggcagacataaaaatatttgacaaatattataattgttatagttgaagtcactattaaataacaaagtagcacagtttgagcttaaactccacctggagagtagaggaaggcttcatagaagtagggcatgaactggactttgaaggttgagaaggctcacttaagaaggctgcggggttggcagtcatatacaaagcctcagaaaggtataaccacatggagtaattgcagaaattgacataatttaatattgctttgaaattgcatagaagtggttacatataaaactggatatgtcagaacgagggtcaggtccatatgttcagctgaagaggtttcacattgtttcttgagaaatggggagtcatttcaaaaaagaggaatcatataaatagatttctgtactagtgaaattatccaagaaacagtgaagatgactgagttcatagtcaaaactggagtcagagagataacagaataattcaataaggtatatatgggaggaggagagtcgatttaacacaggcagagtgtaaatgatgagcaaagaataaatataagaaatcatataaatttcagagattatgaacctgaagtcagtatacatataggagaaatagaagtggtggatgcatgagaagtagtagttttgacaaagatcaattttctatgaaagaaaaggtacagtgcacattttgccttaaagtagctgagggtccttcaggtagagatattcagcgttgactaaaatatacagcaaaattctagaagaaaggtaatagaactaacaagattctatgctacaggtatagcattagcaattttcaatgcacagttagcagtcaaactctacccacttttcagtaactatattgtatttaactagaaatgatttttttgagaaatagattttcaataaaagttatctttagctaagaaaaagtgaaggaaagagtgggtatctagaatctaaagaaaaaagtattattcctctatggaataatttttctttctgtcaagcaacagttgagtaatgggagttatattgtccctcagggaccaaaactggctacgtaaaataataataagattatactcttaggtataaagtatggatataaatatagtaaataaatacacagtataactgtggcattaaaatttaatggaaggcaatgacttggaaaaagaaaagttcatgaatgctcctaggaaaaggtaaaaaatgaagttgagaaacattaatctgatagagggatgtgtcttcctttttttagtgaaggtatttctgagtgtaaggtatttttagtgaaggtaaaatttttagtgaaggtatttcgtatgtaatttgtgaaatcagctctcatactaaaagtgacttaatgatcacaaaatcacaaagactagtgatcttcctctcttaacattcttacatcaagttcacagtctgacattctgacatagtctgcccgctcagttgctgtggagttgaactcctctgtcgagtccatatccctaagggatcataagcttttatttctgagtaaggcagaaacttattgccaagataattagtgttagttattggaagatcattaatggcatcagcatcaaaaatcgctccaagtgggagagcttcctttctcttatggagttttcatttaataagccatgcttccacttaacgtgaccaaagaaatcggttgtattttataaattttttttagaatgtatgtacattcaaagtgagcatagatcttatacagaggatatttttaattgtatattaaaggtttttttcttagcacatatagtcttctgcataaagaagccaagaagaaactataatgataagacttctctggtactatcacataaataatgagttgtaaacaagcttaaaaaatacatacatatgatatagaatatataggcatgcactacttaactaaggggatacattctaaaaatagtgccattcaacatggtgaaaccctgtctctatttctaaaaatacaaaaattagctgggtgtggtggagcacgcctgtagtcccagctactccagaggctgaggcaggagaatcgcttgaacccatgaggcagaggatgcagtgagccgagatcgtgccactgcactccagcctggctgcagagcgagactccatctcaaaaaataaataagggctcagcgcggtggctcacgcctgtaatcccagcactttgggaggccgaggcaggcggatcacgaggtcaggagatgaagaccatcctggctaacatggtgaaaccccgtctctactgaaaatacaaaaaaattaatcaggtgtggtggcgggtgactgtagttccagctactggggaggctgaggcaggagaatggcatgaacccaggaggcggagcttgcagtgagccgagatcgcgccactgcactccagcctgggcgacagagcaagactgtctcaaaaataaataataaataaaataaatatacataaataaaaattaaaaaagtgccattaggtgattttgtcattatgcaaccatcattgggtatatttatacaaacctaaatggtatagcctactacatacctaggctacatggcataacctattccccttgactacaaacctgtgcaacatgttactgaactcaatacagtaggcaattttaacacagtggtatttgtgtatctgaacatatttaaacatagaaaaggtacctaaaaatacactattataatcttatcagaccactgttgtatatgcagtctgtcattgagactgaaaagtcattatgtggtgcatgactctattgtttaaaataagcaagtggcttctctgcctaacctatgcatgatggaaggtcatgagatttgtaatctaattcctctcatgcagagagtcactttggatagataagagcagcctaaaccctagctgaggttaagtgcaaatgggtttgcacctttaatttctaaattctagcaagcaaaattgtttaaagtatgtggaattaacagtctgactttaagttgtacttttcctgaattattttatcaacaaatgaatttaaggatttttaaaaagtatcaattgactgtgactcagtaaaattccatccaagaaagtcaatttctttctttcagtcttatgcgttcactagagatctagatctggggtagaaaacgtaaggttttcctttctaacattttactttcttacatgaaaaaagttttaacttagggtccataaattgctgctgcaagcaagggtctgttcagctgcaaaagtggtagaaaaaatatgaatgtgtattcttttgtttacttttccccctttaggagagatttttcaaaggagttcttgactcgcaagcattaacatttatctggtgctttttcggttcactcttccttttgtgtttggagggagctagtatcattctttatttggcaggagacagaaaagtcacctccatcacacgtttttatggttcccctttagccaggtttatgcttactgcagtgacagccaatttctctttcttagcacaggaagaggcaagctgacttgtgttggcttgctctctctccacatacacttctctcctcattgtgcctggacaatactaaagtctgtttgacaaggccaggaagtctcacataatctaacaaattatgtataatttttaaataaatttgatattaatcataaatgtttcatgctgcaggcattacaatgaatttcactagaatattggtaatggaagagctgaaacatctattgtgccactttgtttttttcttaagtgtaaattaatagaattatttaatgacactattggaagtgattatgaaaaaaaaacacaagagataaaccatgagacaagaacgttattcctttgcatatttcagtacagaccgacatgcagtaataccttaaaaatctgataataaataaaaccagaaaacattggcagcaatcttctttggggaagaagaaaggatttacttttgccatagggtataatacatttacatcataataacaccatacctgtgtcttttataacctagagaattgaactcttacatgatgtcactttttaataataaatgcaggaagttcaccttgagagtaaatagtagctagagctcagtaaattaactgaaggaagagaaaaaaacatatgaatagacaacagaatgttttcccttgaggaggagagcaatagaatattcacagaaaagcaattactgtgaaacatagtaaggtatgcagaaaaagtgaaaggaaagttaatgagtttaatagaaagatggcaataagaaaaataggttattaaattgttaaacttatcagtaaatacatatctatatgtaacatctgtagatcatctgcctgactgcatttatatgcacaacttaccacttttgctcgattgtaaactacatgagaacagaatctgtaatacattcattttaaaataactgacatttcctgttagaatgcctatcccggagttcagatctcagaaacacattctgtaactagggtctatccgaacctccagatccaacacgtataaattgcctgagaatatttcctgatctaggtctaggttgtcacttagaggttctcttgaacttaaaaatccagctcagaaaagatttccatatgtctttccccatgtttctctgtgttcaaacatctgagtcccaaaggctaatgatcattcaaatagaaacacaaaacaagagccttagcaaaaagtataatttctaaaccatgctgcagcaaagattccctggtaaatgtgatatttaaggaaataagtctaaacctttacctaatctaaatttcaatggcatatcatttttgccatcataaaggcaaatgctttgctagtttggtttaatttcttaaagtattgccttaatgttacaggacaccaacacttacccaaaggtggccattgggttagggtttctgcattatagtcccttctgtagtcaccagaaatatgttacaggaatagggttccaatccagaccccacgagagggttcttggatctcatgcaagaaactattcagggtaagttcaaagtgaaagcaagtttattaagaaagtaatggaataaaagaatggatactctataggcagagcagccctgagggctgctggttgcccttttttacggttatttcttgatgatatgctaaaaagcggtggattattcatgtctcccgtttttagaacatgtagggtaacttcctgatgttgcaatgacatttgtaaactgtcatggtgctggtgggagtgtagcagtgagtacgaccagaggtcactgtcatcgccattttgggttttggtgggttttgtctggcttctttattgcaacctgtatcatcagcaaggatttatgacctgtattttgtgccaacctcttatgtcatcctgtgatgtagaatgccttaactgtctgggaatgcacccagtaggtttcagcctcattttacacagctcctattcaagatggagttgtccttgtttatgtgcctctgatattaatgctgtgccttaaactattattgcaagaaatcaagaggatgttaatattcttttcagcatgactaatccttagacaggattcttcttattctaggcctctgacctctcttttcttagaacgtttacattggaacacttcccattccatattatctctttgcccctttgagatataaatcttgttaaaagcatcttaccagtttagaatttaggaatgtcttcctaaagaatctgggaaccatctctttgaaatgtaaatatttgaggagatagcaccccagtttccaatttccttgggagggcagactcctaacatcaatgagtaccaattagctaacacagatgacataatctcaaagaaaaacattttgaaaactcaggaataactaaatatgctccatacatcccacagatcagcctcccttctaacatcttgcaagacattttcactggcttaccctagtatataaaaactctcccacttcttgtttcatctgagttgagttcacagtgagttctggcctttaacatctactgcaatggctttgaataaagtattcctttcctatttaactttatccagtgcaatttttgatttgacaatagttatcaaaaaagtagtcatatcaaattgatgtttcatttaccctgtagttgttataaaatctattacctgtggactttgtttttgctgttttgagatagagtttcactctgtcacccaggctggagtgcagtggagtgatcttggctcactgcaacctctgcctcctgggctcaagccatgctcccaccttagtgtcttggactacaggtgtatgccaccatgcctgctaatttttgaattttttgtagagatggggtctctccatgttgcccagactggtctcgaactcctgaactccagcagtccaccagcattggcctcccaaagtgctgggattatgggcatgagtcactaacttgtcctattacttgttttgtgattgagggtctctgtgttacaggattctctccttagttcagttaaagatgggatccttgtcacatagccatgaaaaattagtcttgcagacaattcaaagggtgaggaaaatgggatttattgggaaaaaagggaaaaaggaagcctccacaaacccagagtccctgctgttcacttcctgccttgcagattgaataccaggttctgcccaggaagaggaggagcctggctcctctctgctgcaaatggctcagacttcctgaggctctaccacagtgcacaccaatcccagtgtgtgggctggtgggggtttgtcgaaaacacctttgtaccagctgtttcatgagaaatgtctttcataggatgatcacaaaaaatgttattttttattgttttttcaatggataaactttatgttgttgagttattgatgatatattgaaatggacttttcattaccagtgaggaaaaagtggcttccctttaccttcctagattatttcattagactacaaattaaatgatcataaaacagattaccaacaaaaaaactatagttaactatgtacatgcacaggagtccaacagaaatatgagattcaatgaaaagccagatgattgatgcttacatagcattctgagctatagagaaatatttgaggcttggggttagtgaaggatggtgaagacaagttataagggtgagggggtggagatgtatggtaaataaatgttgtcttgttctgcagatcaaaaataggtaataaaattgtctcagaggagctatcttcctgtattggacatctgtattaagtacttttactaaagcagtgaagaggcaaggagaaaacttccccttcacccttggaaggctcactgaaaattcaactctcaaaagaaagattaataagagaaaagccatctcatttattaaggtgcacatggagagatccggagtgattacccaaacccctagtggggtatagaagcttatataccaccatgaggttacagatagaatggggactcagagcccaggcaaaaataggttatgttggtaaatcaggttatagcagtaaggcaggttatggatagaagagaagcggaggcttggctagcaaaggtgaccttgtaatgtaaatgaaaccttgcatgtagctgccctcagataaaatagatggcatatatttctttcaggcctttaaagctgtcagactctcagttactctttgctagatccaggaaagggaagtcctggctgcatcaatgcagattgtccacagatgcaaatctctgccacaaaagatagctttgtaaggctacatctgtttgctggctctctgaacagccatctccatgtatgccaaataaccatattttggggtatgatactgttcgggtctgtgtcccaacgcaaatctcatcttgaattgtaatccccacgcgttgagggagggacctggctggaggtgatcaaatcatggtgaggtttcccccatccagttcttgtgatagtgagggagttctcatgagatctgatggcttaaaagtatgtggcagtttcccccttgctgtctgtttttcttcccccttgcgaagaagaaggtgcttgctttctccttcaccttccaccatgattgtaaatttcctgaggcctcccaaggcatgcagaactgtgagtcaattaaaactctcttctttataaataacccaatctcaggcagttctttatagcactgtaaaaacaaactagtacagcataaaatatttttttcttcagtagattttctttatagattacaaaaggacaattttcagagctactccttttctgcagtttctcaggataaccagctgaaaatataccaaaagaatctactttgcagtggcacattctgctctccaacagtcatatgagagttaggctcagatgtatcctgagccctaagagtgccaaatcactggtacaaaccaaaagtaaaattgtaaatcccctcagccatctgcatagaccacctcctctccgtcaagagcattccaaagttaacctgaaaagctagttgaggccatgatgggaatgggaaacaagccatgtctcattatactctcctctgttttggaattgctgatagaacagactctgagtctgataggaaacatttacaatctattctctgaaacctgctacctggaggtttcgtctgcataataaaaccttggtctctacaaccctttaacttaatccagacaattcctttccattgattctgagtctgtataatggcttaactcttcctaccaattgccaatcagaaaatctttgagtctaactgtgacttggaagccagtttcatgcctttctggagtgaaccaatgtggagtacaggagaaggtcagagagactttgcttccgaggcttccatttcctttatttcaaagtactcagcatgcccaagtgccatactttggggtatggttttctgagccctaacaagagtaaaatctgtacatgaggtaacagtgtgctagagacacagtgagaaatagctttgttaatggggtagctatttgaataaggcgtcttttcctaggatctgtcaattctcaaggacagctttaggaaatatgtgtctcctcccaaactaacatggagattttgtgatgtttatgtattttcctgggcaagaagtttttctatttaagtcagttctcaatggattaaatcttcaaactcttaaggccaaacccatttaaattaatagaagagcatctcttttgttggaccagagtgatttttcagctattccaatagtgatatagaggtagtatgtttagacattcctctgggcatgcacagctttctggtaagttcaggcccatcatctaaatatcatacttaaaaacataaatgggccgggcgcggtggctcacgcctgtaatcccagcactttgggaggccgaggtgggcgggacacaaggtcaggagatagagaccatcctggctaacacggtgaaaccccgtctctactaaaaaatacaaaaaattagccgggtgtggtggcaggcacctgtagtcccagctacttgggaggctgaggcaggagaatggtgtgaacctgggaggtggagcttacagtgagccaagatagcatcactgaactccagcctgggcgacagagcaagactccgtctcaaaaaaataaatacataaaataaaataaaaaataaaaaacataaatggaacaaaaatgattttattaaacaggggtcttccatttacattagccaatgttgctttcctcaaattgtgcacaatacccacagtgttgctaagagtgacagagattaatggaatcaaaaattatctctcactcatgcaggtgcaagttagatttcaaattgtatggccatttgctttgttctagggaaaactctttctttagtaatagcattctactttctatggtaattgagctttccaaaagcaaactgcttcttcaattatgtttccatgaatgaaatttttgcagaatatatgaagagttctgtttctttaaacactttaaaacattagtttacttttttatatactgcacaagtgcaatgaaatgaactcattgactattatttaactgtgatgctgaaagctaaaatattgcattgcaagagcttttagtgatcatcatttagcattttaaaggtactaaaagcactattcatccatcaaattgttcatttgtttaaaacacgtgcaacaaaagctgagtgtacctaaaagcacaaaataaatctgctcccttgcactttagttagatgaagcagaatgtgcacaggtaaggtcagtaaaaacacatacacacacgcacaaacacacacacacaaacacagtatgtttgtactccaagaagttcaataacagttgaatgcacattcataacacatctttggaaaacacatgaatatacttttaaatcctgaaacaataaaaaagagaattgtcacaagattggtttggattttagtatcattctattagaagtaaacttcataatcattttaagaactgcaatcatctgttttactttgcatttctttcctttccttgtttccctctgtctgcttctgggctattagagtttctcaaattgtttgtatcacatagatacccacgtaaatgctgcagggttaactccaagacactgttagacacaagtgtgcttgtatttcaattcttgtaattataagtggccccacttcagactattctgttctatgaaacacaacggaaagcatcaaattaggggaaaagagtggctcagactgccccaagcaattaattaaagaaaattactactggatgctttatgcacagcaggggctctgtgcatgaagaaatataactgctagtcacacctgtgctgattctcactgtggaattgaaattatcatgagtaaatgtaattacttagcaaatttaataaatgttgtttggggttctgaaaacagcacttggatctacaaattacacagtgataagtgtggcagcacaagttcagtggtctctaatagcactaaaatatgtagagcatcctggaatgtaccaggaaagcttatgagtaagtaaaggtaataaattgctacaaaaaaatgggtactaagccactcatagttacccatgctttcatgttttcctttgattatgtaattttgacaaagttatttttttcaaaatccccagtagtttagatatccaagcttatcctcctgaaatacaaataagtttattcctaacaaaaaatgagttagtatttggtaacgcttgaaatgaagtgctctaaataagtatttaattaagaataaaacagctattgctcttgggttgtgatgattggcaataattgctttacatgatttaatggttataaaattaacaagagataagtaataaaaataagaaattaagctacatttttcatcataactttaatttgtatgctcttaagaatcataatgatgattggtcttttattaaatgaatattaagatgaaccttcatataatctatattatctttgaagaatatgttaatcattaagtcataatttataattaaaatgcaatacaatttattttgtcaaaaggaaataaagtatttgtgtattttgtaaaattgccatatggtaaaagcctattcagagtataagccttctgctataatactaatagccataagtcttctactttaaatcaagaaaatgttagaaaatgtttaatagctttagtatatttaaacaattcatcaaaattatttaaaattttgctagggctgtcataacaacatgccacaattgggtgatcaaaagtcacagatacatattctctcacagttctggagactacaaatccaaaatcaagctttctgtgggaccatgatctccacaaagactctgggaattaatgcctccttgatcttctcccttctggcgtttgctgtcaaatttcagcattccttgttttgtagacctggcactgaaatctctactttctttatcacatggtcctctcccttgtgtcttcatgtcttcatgtcttcacatcatcttccttctctgtatattcacatcatctttcatctgtgtatgttcctatgtccaaatttctcccttattagggaaaggaatttatctagtatccaatgtcttaagttcaataatggattttgtggctgcactagtttaagatggctatatgtgaacttgattacagctataagaatcctatttccaaataaggttacattcgcaggttctgggtgggcatgagttttcaggggccactaattaaccgagtacaaatataaggtgttaatgttcttgtaagtcgtgtggctgacttctccctgttttgtcagtgccctgcaataaatacaattcccacttagtatgcacctatacacaaaaaagaatatttattatgctctaatggaggaatcagggtcagaacacttattctgtgaccagataatacatattttaggctttgcagaccgcatggtctttgttacaattgctcacccgtgctgtaaacaataggtaaatggattggaatagttggatttggcccccagtcatgattttgcctacctttcctatggtggaaaggaattctttattttgtttaacagagtaaatttaaatatctatatcaaggaaaatctgttctttgaaagcattgtccacaatttttcaaaacccagattttatttttaaagctatttcaagacctaggaaacataatgcattttaaaaatcaaacccatatgaacaattaagcctagagaaaagaaatacatatatttggggtgaattgtaaattcagacacaaagcccttctgagtgtgggaccccatgtgacttcacagatcatatgcccttgacattaattctgtctgaaagtatttttgaaatcttgttctttcaacacactaggtcctactaaatgggatttttataaagtcactagtaataactcacaaatggatcaaatgaataatatattacttaaagtgcctattataatgttttgcacattaagtgttgtcccagtacagaggtttttagatgtatttacacttttaataatataaatatcaagtggtgagtattgccccaatataaggttattttaaatgtgatttattatataattaacaatattactcttataatcatagtaatattttagtcaaatatcaacaaataaggtgctattgctttatgagtgttttgtagaaatagtcaaaagttctagctatgaatcctgaaaagtcaacacttagtgaaaactttggttcactaaaaaattatacaaccaattttgtgaaattactgttgcaagtctcattcatttaagtgtgattaacaaaggaggttaaatttcacatagcataaactttttctgtttttttatttttagtgtgagaactttctctaggaataaaaaaaaaccctcatgttattttcgttttaaatgtataacctttggcacaaaactgagaaaatggctgcttcactagatgtgaaactgcctttcccttgcaagggttaattactaaagaagaaattcaaacttaaacaacaaactctgcaatcttaattaaaaagaaactatcaactggtgactccgggtagtttagagatgacaagtatcaaatatgtggtaaagtgaaatgtaaaaagtaggagaaggtgattataaggcaggtcagcttttagatttgccatagcagagatagaaatactacgactgattttaaaatctgtatgttgaactttacctaatgagttttatgtggaggcagatgaatagagtacagaacacaaaaactacatttgcgtaatggaatatggttctgcttaactggcaagagaaaattattttttaaccattaatgcaaatatctactgtttcattttatgttatctgattattttaaataatgtgtctgagtagcaaatagaaggcttttttccaacaaaagatcattatatcatttcatttttccaattctgtataaatgtccaagttagttttttttgaggtcttgcaaacaaaatagacattcaaatattcagattttaatttttcttaaattaattttgttatttaaacaatgtaaaatcttataccacttgatatatgttgataatccataattccatttgatggcacaataaaaatcacatttgtgttttaaattttaaaaagcaggatttatttttaaactaaaaatttagactctcttagaataaattacacagtctcaaaatactattgcactctgctacaagtgaaaagcaaaattttttttattaaagaagttcaatcttagtgaaataatttacaataacctagtagggatggtgtttaagagattgaagcaacataattcacttgattctgatacatacatacaaaattttctaacagttacttttaaatacattggctctgaaagttcattttaattctttattctgagtataatacttttattacaattttaaacttaattttataaagacttttctgaagtataattttaacccctcatatattttctaaacaattgaacagaatatttatagattgaaattttaggcttaaaacagaccctcttaatattccaatcttttttgagtctaagcccacgttccctgatctaacagataactttaagaaaatgatattaattcatgtcaaacaggatttctgtctttgagagaatcacttactttcctcaaagttatttttgaccatctattgtgcttaatatgagatggttattgagttacttgataaacttgtagtttccatacataaaagtataaccattctgaatatcaaatacttcatgataataaaattataatttacatctatattttactttgtctattcaaaaaatgtttagaaaaagtacatggagactgtagtcagcatattatttcaaaattaatactaatgttaatgtatgttgaatacctgtgatgataataactgtacattctgaaaaaaatgttactatcctgtatctaattgctaagtaaatcactcaccatttttaagcacttattatatgccatgcagtgtgatatgttgtgaaaggatgtataaggtgacacaaggttctatcattaaagacatgaggaataaacttatcacaataaatgatatctaatggcttaaaaaagaaagaaaatattctgactgtgttattagagtttcaggctggggaaacagtcacaatgatgatgactaatagatcatttaggccttaaacataaatagaactttattaagcatatagaggaaggggaaacaaatctatgtaaacgaaatagtatgaagagaagcatagaagataaaaatttaaaaatacaagaaattttaggaaatttttaataaccaacctagaaaacaacttgagattcttccttatttttaatttcatttatacaccatcattaaccttgctgagtcttcctccaaaatgcctcttaattttattacttcatttctatttgtgttacttgctgaataaagtttcacgtcatcatgatcagggattcctgcctaagggtgattttcatgcgtgaaggatatttggcagtgtgtgaagacattttttattatcgcaagtgggggaagagcactagtagtatgtagcaggtagaggccaagtatattggctaaattgtagccaatactaatacactgaagaatatgctaaatattctacaatgcctaggtcaagttcccataacaaagaattatctgtccaaaatgtcaaagtaccaaactagcaataacttcctaactttatctccgccttagaaattcctattcttgattagaaatcatctagtcatgtaatgaatttgatctactataaaatatccaagaagagatatctatgagacagttaaaaatctaatgttaggcatcaacagggaaatcatttttggagatacaaattagtgagaaagtataaaggttcaaaatacagagatggttaacattttctagagaaaatctttaaaaggaaagaaaaaataataagataataaaatatttatatttaaaaggaggatgggctgggcgcggtggctcatgcctgtaatcccagcactttgggaaggaggccgaggcaggcaaatcgcctgaggtcaggagttcaaaaccagtctggccaacatggtgcaaccccatctctactaaaaatacaaaaattagctgggtgtggtggtgcatacctatagtcccagctacttgggagcttgaggcaggagaattgctttaacccagtaggcagaggttgcagtgagccaagaaagaaccactgcactccagcctgggcaagaaagtgagactccatctcaaaaaggaaaaaaaaaaaaacaaacagaagaatgaggatgtatctgccaacaaaatattgaacaaacaactgaaacagaaacattaagaaaggggaagaagagaacatctcttaataaagcacatgggttcagctactgaccacttccatgaatttggctgtcttcaacatgcctttaggattagtaataattccactttttccaaatatatgtttgttatctacacatacattagatattgtttcttatattgttaacccttgtatttattctcatttggtaaagtagtacaaccaacagagaataaaacaagttatttcaaaatgtaaaaatctggggggtcacaggatagaaggcaggagcacatcagtgggcacaaaatcccagatgaataccaaccatttctcagcttttggccccttcaatccactgcatgatgcaccaaggatgttcaggaaagtaaaatagcactctttcatcaatcatttctaaggcatctgtaaaatgctgccgttttcagggaagaggggctttttcccttacctgaaatgaaaatcagcttaacagaaattgagcttaaacatttacccaactcagtaattttggcatttgtgaattacctgatgaatacatacttgtttcttatctagaaattaaaaaatcttacagtggttttgtatggtgaaaaatctatttctatcattgacccaagtattcccagtaaggaaagaaaagcttttattgtattagatcctgcttgcattaaaattatctttaaatattttgacttcatctatttgttaaaactatcaaatagcttacttagcaaaatgaatatttaattcagaaaagaaaataaagcaattactgtgtgtatattcagccatatacgtagaaggtgccaacttaattgcttagaggggaagtctttctttttcattctatggtcacattcccttttaaattcatatgtgtgtatgtgtgtgtgtgtgtctgtgtataatttatatataattgatgtacaaatatatatgacataaatatatataaatatatgttatacataatatataacaatattatttatgacataaatatttgtatttacttatttgtcaaacatttagtgactgtcaacaatatgcaaggtgctaagcatgccactatgttaacaactataaaaaagccaaagaagctttgagcttggaatctgaaaggagagacagaaatcaaagtttatttctgtctacagaattagtttattaaatattaataaatgatgtttgagaaaattataagttgctatgaaagcataaaccacaggatatgacaagtctagagattttgataaagctttgtagggagaatttgaatgaatcaaactaagaatttatgaagattgagctggtaaggaaaagggataaattcattctaggaagaaaaggaacagcagaatgtccttaggaagaagtgagcatgaattatttgctaaaagtggaaaatgctaggaaattacatggagtgcaaattacacacccaagtagagatgtgaaagtgcataggaaaagatgcagcatttaatatgcatttaaagtttattattaatagcttgaaaataaatacatgaatgaatggatgaagaaaagatttagcagaagattatttactatcaagaggagcagaaaatacttattagacaaaagtgaaaaatgcacagaaaattgagttacttgccaaaggtcatctggaaacatcaaggaaagaattaaaacaaagtggaaaagaagcacaagcttatagaaattatgttgagaccagaggctatttatttttaaaattggaacacttttttctgaacttacaatacatttaaattgattggaaatattattcatacacatatctaagtcaaatatataatctacctaatggtttctggcatgtattttcctttcagtcttttcttcagcacataccatgaaaatacatgagatagaagggatttttaaaaagagacctagagattgtggggctacattattcagaataaataaaagcgaaatgaaatctaatttaaaaacatatcacaagatctaacttactgttatatacacaaagtgcattttagtagacaatatacagacaatgtttcttttaaatcaacatttgttgacaatgttatccattatccactattattcttattagttgtgtcttatttttattaatttttttttctattggattttttatgagagatttgtttggttataagattttaaatgtggctattatgtcagaatacatatctcaattcaaatgaaatctttttccaagtttacaatcaactgtgtccttccgtaatttaatttgttgaaaataggaagcatactggtagtacattttagtaattttaaaatcctttagtaaaggaaaaattacattttggctttgagaaatatcatcttcaagaataaaaacactctttcatattcatgtattcatagagcataaggtattcactctatagtacgtttttagatttgcaaatatttttgagtagaacataaaagaaatatctaacttcctaatatcaaggatggtgtgaacatcagaaagctacctttgttatcctaaaacaacttaggttttgttgagaaaatataattaaaaacagtcttattccaatcttgaaaacctctctacagaggtagaagagaaaaaaaaaagcaattttattattgaataagcatgaaaccaggatgtgatgcacatcacaggcaatccactaaagagaatgcagacagaaaggaatctcacccttttatatagccaaacagatgcaacctattgtatacaccttttcattgttgtgagataatcataggatgtaatggacttacacaaaattggatgttcttatagcacagaggctatatggtatagcctattgctcctaggctacaaatctgtacattttaccaattactgtaggcaactataacacaatagtatttgtgtatctaactgtatctaaatatagaaaaagtacatgaaaaatacattataatcttatgagaccgccatcgtaacatgatccattgttgaacaaaatgttgtgatgcagcacatgaatatgtaggccttttagtaattattcaatcttcctaaatagcttttttcagttttgcaactcagtagcatccatggccatcatctaatataaaagtcttggccgggcacagtggctcatgcctgtgatcccagcactttgagaggccgagacgggtggatcatgaggtcaggagttcgagacagcctggccaacatggtgaaaccccgtctctactaaaaatacaaaaattagctgagcgtggtggcaggggcctgtaatcccagctgcttgggaggccgaggcaggagaatcgctggaacctgggaggcagaggttgcagtgaaccgagatcatgccattgcactccaacctgggtgacaagagcaagactctgtcacaaaaaaaagtcttattataaggtacaaactgaaaggcaccgattaaactttgagtgtttaatgtatatagctattattattttaagtcttgaagacaaacctctagcctataggtattttttttcccagcgtgggatctaaaccaatagctctacattataatagtcaacaaaatattcatgagtaacagaaatttagtttcatgtatcaatctatacttaggtgggagagaagttacatcacaaagttaattaagtaacaatagacctgttttttgtggtcgctatcttacaatgccaagtttctatttttctattaactggaatgtttgttttcaattaagccaattaattgtttttgtttgttttacaagtagagcttgtcttagtccattgtgtgttgagatagcagaatactaagatggggtaatttaagaagaaaactttttcttacatttctggagactgggaagtctaaggttgaggagctacatctggagaggtcatcttgccatatcataacatggcagaaagcaccatatggctcagatttctcttccctttcttaaaaggccactaatctcatcacgggggccctattcttatgacatcatctatcactacatcccaaagaccctgcctccaaatagcaacaacacataaatttgggaatttaatttctgacacatggaatttggggacacattcaaaccatagctaggcttgaatacttggatgcatattagttttattttattatcaacaattataaagaagatggtgtcacttttactctgccaataataaaactgttggttatacaattccaggtcctgtttctgctgggaggacaatttgaactaactggaaaggacatcatgagaaccattactgggagtacagaaagaaaaggtcatgtaacaaataagttttgattcctagtaaaatgtgattcttaaagtagtcaaaataatccactggaaataagacagtaagaccatctaaaatgtaatatgtaaatatgttctctagagtacctcttcatctgaattcagtaccaagatcagttactcttgaaaacttaaatttcaaggccttgtgagaaccacagtcaagtcttgcccaggtgctgtctccgtgtgggaagcatgactccagctgagttgtttctcttttgttttggttttggtttttgttttattttgttttaatctctgatagccaaacgagtgatcagcagcactcgaaagccttctttccagcatggtgactgtattttctttctggaatacctttttgtagatgaaatttcctggtccacagagatagccaatttccactggtgtgtccttccagatcctattgtctttaagttttagggtttctagggaagatataaacccttttaggcattggaaatggttagaagaggatttgcttatatcaggcacaggatgtgctcttagacccaaattcatggacctgccaaatgtaggttcaaagagaagattctgtgcttgaatgcagaggcagcaggaaaaagactaatgataaaactctggagattttaacccagtacatagctgaatcttagctaattattttttaaaatttgatttatctactttatttatctggaggactgaggaatataaggtgtatgctacattatggaaatcagcacacgtttgcataaatcctaggcaatggtacagataaaataactttctctgtctgattcaaatactgtggtatcccaaaagttagaactaaggcttttaagagagtgtttaccattgcctgaaaatcagtttttatgttttgtttcttttttttttgaagagggtaaggcctcaggccatccagacatcatacacacagtaaacagacaaagctcttaccttttacatgtagttctatggaactcaactaccaaaaggctcctggtagttactcagagagcatttcctgtggtttcttaggagtagcatgtaaataattctgctgatgaatatcacatctctctaatatgtttgtattaaaaaaatcttttttggtgtgcaggctcagagtctagtgactttaaaaatcattttttcttgagatgatttgttgatgacataagaaccctaaccaagctgggcacggtggctcaagcctgtaatcccagcacttggggaggctgaggtaggtggatcacgaggtcaggagattgagaccatcctggcttccatggtgaaatcccatctctactaaaaatatgaaaaattagccaggcatggtggaagaagccaggaattcaggttctgggactttttaaaattttgacatgtatattgaatattcaagtggaatgcaaataggagttggaaagtcagaaaagtgttctgagatggagatgtaaatatgtgagttactggcttttcaagagtgtttagagcatggtaatgagtgaggtcatcaaaagcagtagcatgaatacacaagagatgtctaaggcctgatacctggaatactccaatgtaaagagcttggggagaagcagagaaactaccaaaggagattgagatagtgttgcaaataaaacagaagaaaaatcaaaagccatgtgatacccagctctaggaagcacaaatggtaattttgtgcaaatcaaaaatgtgtcctttcctcatggcacagtactgccatctgctggaatatgtttctaaaaactgtattaagattataatgcccccaaggtaaatgtccttcagtgcttagctgtaagcagtagagaaagtgtatgaaggtggaggaagtatatcaaatgtttctgatctgtttaaggcttatgagtattgaaaaacaattaatggatttagcaacattaagtatgtggtgacgttgacaaatgtcggtttgaagtcatgaaaatgaaagtttagttactgttgagtttaaaagaaaatgaaaaaaaattgtacacattattttcattttcttttaaacctacagtaactaaacttccattttcatgacttcaaaatgacatttgttatggtcaccaaataatctgtacaacaaacccccatgacacaagtttacctatataacaaactgcacatatgtccctgaacttaaaataaaagttaaaaaaaagaaataactgtagatagtgacaatggaccattctatcaagaaattttgttggaataagaggcagagaaataggttagtctgtagttgacatggaagttgcttcaaggaagtagggtggaaaaattggtaatgaaggagaaataagaaaaattaagaccacagcagtctgtagtagatgagagagaataagatctaaggcactaatgaaggaattgtctgtagagagacagaaatatatagttcatgcacaggagatggtgaaaaacagagtatgtgagtagtggctctaggtgggcagatatggtaattagagtccatagacactttcttcttttcacagtatagtaagaagcaaggtcagcaaaagcaagtagggatgaaaaaggagatgtgagagctctctggctagcatcttctcactttactattgctatgggaactgggagaatctcaaaagtatttacatacttcttggagaatacatttttctgatgaatatttatagcaccagcctaaacaaatattatttagtagaacatgcttgtttttaataatcttctttcctcacagtgttatctgttctactcatgtattgccaagtgaccatttcatctgaatattacccaacaggtttgcatccttctctgaccttggacagtggcatgtgtttctaacctggttttcttctccattaatgaaacacattattatttaatttccaaactctgtcaaataaatgtgtgaaaatatattcatgtgataaaaataatcactgataatttgtaatacatttgtagaagtgtgacttgtacctcatttgtgtgctgacgtctagtgcagatctcagagtcaggccaactctccattgtcctcactatcctacttgtcttagtctgttttctgatggttataacaaaatattttgtactgggtaacttagattgacaatacatttatttctaacagttatggggactgagcattccaaggttaagggctacatcttgtgagggctttcttgctgatgggaactctgtacggacttctgagccagcacagggaatcacatgatgaaaatgccacatatgataacatgcggtgctcaagtctctctccctcttctgataaaaacaccagtttctttcccatgaaaaccaattaattaattaactatttaaatacaccaaactatgaatgggctatttcatgaggccagagccctcttaaaggcctcatgtctcaatactgccacgttagggattacatttcaacatgagatttggaggggaccaaccattgcacttcacttccccattttgtgaccaaggccttcagactacaaagtagctatttaattctatgtttttgacattgtcccatgcctgccttttagtcgaagaggtatagtttccatggtttcaaacaatactaacagtcccaactatcttttctttataagatcaatatggaaaatttgatgaaataaatgaaaaaaactgtatatatactaaactactatgagctagttaatacagaatttcttgtctccattgttgatgggggtgactaaaatttgagttgagtttctgcctaatttcaacttttattcttgaatgggggatttccccatttttgaatactactatattcaagaagccaagcacaagaaatatttaaggataataatggctattttcttgcccaaagtggatattttgcatctctaggttttcaaactaatttatattgctcttaccaacttgttgcctgtaatcatattttccatattgatagtgagaatctttatctcattccctgcctttaaagataacttttattatagattttgttactgtttacaggatagaatgttactttaattcttagttttcaaagagtttttattaaaaccaagtattgaacttttgcttatctattacactagccatatatttttctactttagttaactactttggtgcattgaaaaaatacattttataatgcgtagtcaactttacagtcctgaaataaactgataattatgtcataattttattaatataccctgggtttgggctaaccactggttcatttaatggctttaacattttcatctgcctcactttgagtccaagataaaactggcctacggtattatatttctactttctttgttcaataatgttacaaatgttaccctaacctcataaaaacattaaaagaaattttagtatcatcaagtggtgagagaatttttgttttctatttcctcttactaattgtttccaagatacctggcttctctgtaaggctagtttaaaatgttacacttcttacagaattctagctctagataggccataattacataaataacagaggatgaaaatcccttcaaaggatgaaacatagaaattgatgtagtaaagctttaggctgtccaagataatgttttctatttaaaatattgcaaatctggccaattgaattaaattcactttgaacaggctataataagcacttacttttggtgtgagtaaataacaaataaatcacttaagaaaatacggcattattccccctcatggtgcatttaaactagaataaaaaattgttacgagaggaagatgaagtcaccaaaagagctgagaattgttaaagaatgtcaggcagaatactcataaggttgaactgataacataattaggtacttgctaaaaacttaccaagatacaacctgggcaataacaccctctagaatggcaaccagactatatagagtgttaaaaagaagaatcttggtaaaaatgaggctagcaattaaaaatgagaaaactaaggataaacagaaagggttctagaaacaattcaggaagagatatttgaaaggcatgtggtatgataaagttcaagtgacataaaattaatagtaatatcatgaagcaaaaagcagaaatggaaagatatagaacgaaaggggataatcacttgaatcacaagattatatatttgagttcagtacactgaaatatttcatttttcaatatgaaagacatatagtgacctctaggcactcattttaatatacaagagccattaaaaaggcacttcaaggtgttagcaggatctactccattataaccatggatgggaggtttgcattcactctgaaaagagtttcctttgcagttttatgtgagaaaaatacagtatcaaaatgattatattgtgatacagaatctccctattaaccaattgcaatgacccaaatatgaccccacaagaaatgaatctggtgcatataactaacgagatgggtgaaattgttcatcctgtaaaattgatggtcagtcactgaagagaagaatttgggactgcatttcaggaaaaagaaccaaaacagtaacagttctgcttctacataattatacggatcctcatgagtcacctgtgaagaaaacaaaacaaaacctcttctcaaaattctgtccactaatttctaaggaaaaaaatgtggtagataggaaacatgatactgctagagcacagagatgcagataatgaatgagaaatctttctctaaattaagatttttaaacattgattttgctatttgaatataggaagatgactcctgttttctcatttgatatatttaatggtgagttcacagatacaattgtttcctcggcttaaggtcaatgatcatggtggaataggaaaatagagaaaaatgctgaaagttttcagctttagtgtactatctgttaaaaagagtatttcaaagacactgtttttacactgttttaatgaattcagactatgtctcatgatcttttggaaaattgaaataatctcaaattattttcctgagtacaaaatgtcaatttaatgagagtttaaatgtgatgacccaattatttcaattaaattatacaatatttattagactataagttgcaaactgctatcatataactatgaattgcagaagatagaagaggatgaaataatacataagaccataaaattaattatatcattctctctttcatagaaacagacaatatatgctcattataatatttgatgacttagctatcataatcagttctatgttttcacaatactgtttatcctgttataaacctaaattccgtttgatcaattatcggtctcagagcaagggaatcagtcttgcatgtattaattgaagcttatggtatgaagtacagcccaaagattaattttgcaagaaatataactataaaccagattctgacacctctatacaacacattaacacatctttgtcataagcacgattcaagacaacaccactttagaactttagttctctgctgttgaaggttgggagattttgtaaaaattttttacaaagataatctagtcatttcaaaaatctgccataagagaaagattttaagtttgaaagaagtcagaactatagttaatgatactgtattgtttacttgaaatttgctaagagggtagccttaagtgtaacactatgttatacgcatgtacaagtgagtcttaaaacaaacactcatgattttacttgtagcaactttgatttgctctctttacaaccaaacttcttgaaagtgattttgactcccagttttcaattcctcatttaatattattttaagtcataacacattacttcatttaaagccctcctagtcatactcctaattgttcttgtctctaccaggcacttgacatttatccaaccattcagttattaaacaaatattttttcagtgcttgacctgctgcctattgctgggatatgtcctggaaatccaacagtggatgcttctattgttttgtctacctccgtaaatagctctgcttctgttggtctccagcaatgctgtccaatctcaaccagttagttatgcagaaaatgttgtaaaactcatgtgccagcattatctttatttttgcctcaaaaacagagcctattgacaataagagtaaaatgtttcagttcagaggcaagaattatacaagtgaacattttgaagtaatgacaatgagtgactataacaaaatttagagacttataaaggaaactacgtgatgcccaggtgctgaaacaccattcatagtggagaaatcaaagtcacgccatgtgtgttttacaaatcattaacacattcagaataaatgcttgaaaatatgaatagcttagagaggaaagagtttttctgtcctacttacttacctatctgataacttgtgaaaatggctgcttcaacctgtatgcacattcagtgtaacatttccaaaacctatactttctctaatatcaccgagccatgtcaggtgaaaatacacgtaatttctgtagctattgttttgtgctaactttacagaattttttcagtcaaccaacagtattacattacttagtagtgcccttgtctcagagccagttaatcataaacattccgacaggttgaaccatctaacaatggaatggattctcatgtgttttctgcacactcgctccccaattatgttctatgagaagatccagaagagactcccttcactaagggattaagaaacatatgggtaaggggagattttccatcagtgaaagttctctggttgctcacttctgtgggccagatatgactataaaagaggccacaattgagaaatgctcacagatttcaataagaatgatgtgattccagaaaatcacatgcaacattgtagcacttaaccaccaaacaaaatgtgggcatacctacaatcaaggctggcagagttgtacaggtcatcagagtgtcttggaccaagaaaacttgggcaggggctaaatgatattgacatccttagaacaaaatagagaccctttcagaatattgcttaattcatatgacaagaaattcttcaggtctggagccaaaaacttgactccagtcaccactgtggagatatagcctcccaccaagttttatgttaattttctgattcagagccctttgattaaatagggtgcctggagggctctgcactattgacgcaccactcacagtaaatctttccccatgccttccccaaagagacctgtggccttctttatagcatatctactctgtgaagcaattcactgtgaatagcttttcctggcacctgagaagtttacctagactactcttcttcatggatttcatagtctgggactactggtcacatctttctttccagaatactttcctattttttgttgttgttgctgtttgttgttttgagacagggcctcattctgtcccccaggctggagggcagtgacacaatctccactcactgcaacctccacctcccaggctcaaacgattctcccacctcagcctcctgagtagctgagaccacaggtgtgtgccaccgtgcccagctgatttttatatttttgtagagacaaggttttgccatgttgctcaggctggtcttaattagagggctcaagtgatctgcctgccttagcctcccaaagggatgggattacagatgtgagccaccatgcccgatctgcttttccatttggattcatggaatagcctctcctgattctacttctatatttttagctactttgtattattggagcataatatagacacagaaattgtcctaaattatgagagtgtaggtcaatgagtttctcaaatagaacaacctcatataatcactacattgatcaacaaatagggcagcccccacaccttagatatcatcattttgacctcttccagttagtaaccatctaggtttgtcattaccttgacttctaacactatgaattagtttcgtctgattttgagcttaatataaatgtatcatactgtatgcattcttttatgtatggcttcttttgctcagcatgataaatctaatgtttggaagattgcttcaatgttacatatcattatagtaacattcattttcttacctcttttgtatgagtaaacacaaattatccattctacttttgatgaacatttgagttgtttcccaaatattactgtattataatgaaaactgttatgaacattatgtacaagtctttggagaacatattatacacttctgttgtttgattcactcattaaatattatttttaccagtgttctgaaattggtcctctttggtgatcacgcatcacttttgttactacttatttctttaaaatttctacaaacacatctgtctgctgagaacttctgaacttttaacaggtacttccagtacttaatatttaattatttttcttctttaattttcctttctatattaccttcttagattaatgtgtgcaagacacacggtagagttacttaaagtattgcctttttcttatttggtaatgaaatgtgtcaattctacttaattaacaaccctatacttaatgatcttctgccacggtcttagtttctgccttcatcttatttgaaagtgtttgtaaaactaattttctgatagcaatgctgatgtctagtgatttagagtagttgggttgttaaaaa
